(12) United States Patent
Chen et al.

(10) Patent No.: US 9,193,957 B2
(45) Date of Patent: Nov. 24, 2015

(54) ENGINEERED IMINE REDUCTASES AND METHODS FOR THE REDUCTIVE ANIMATION OF KETONE AND AMINE COMPOUNDS

(71) Applicants: Haibin Chen, Singapore (SG); Steven J. Collier, Lexington, MA (US); Jovana Nazor, Santa Clara, CA (US); Joly Sukumaran, Singapore (SG); Derek Smith, Singapore (SG); Jeffrey C. Moore, Westfield, NJ (US); Gregory Hughes, Scotch Plains, NJ (US); Jacob Janey, New York, NY (US); Gjalt Huisman, San Carlos, CA (US); Scott Novick, Palo Alto, CA (US); Nicholas Agard, San Francisco, CA (US); Oscar Alvizo, Freemont, CA (US); Gregory Cope, Menlo Park, CA (US); Wan Lin Yeo, Singapore (SG); Stefanie Ng Minor, Redwood City, CA (US)

(72) Inventors: Haibin Chen, Singapore (SG); Steven J. Collier, Lexington, MA (US); Jovana Nazor, Santa Clara, CA (US); Joly Sukumaran, Singapore (SG); Derek Smith, Singapore (SG); Jeffrey C. Moore, Westfield, NJ (US); Gregory Hughes, Scotch Plains, NJ (US); Jacob Janey, New York, NY (US); Gjalt Huisman, San Carlos, CA (US); Scott Novick, Palo Alto, CA (US); Nicholas Agard, San Francisco, CA (US); Oscar Alvizo, Freemont, CA (US); Gregory Cope, Menlo Park, CA (US); Wan Lin Yeo, Singapore (SG); Stefanie Ng Minor, Redwood City, CA (US)

(73) Assignee: Codexis, Inc., Redwood City, CA (US)

( * ) Notice: Subject to any disclaimer, the term of this patent is extended or adjusted under 35 U.S.C. 154(b) by 126 days.

(21) Appl. No.: 13/890,944

(22) Filed: May 9, 2013

(65) Prior Publication Data
US 2013/0302859 A1    Nov. 14, 2013

Related U.S. Application Data

(60) Provisional application No. 61/646,100, filed on May 11, 2012.

(51) Int. Cl.
| | |
|---|---|
| C12N 9/06 | (2006.01) |
| C12P 13/00 | (2006.01) |
| C12P 13/02 | (2006.01) |
| C12P 13/04 | (2006.01) |
| C12P 13/06 | (2006.01) |
| C12P 17/10 | (2006.01) |
| C12P 17/12 | (2006.01) |
| C12P 17/16 | (2006.01) |
| C12P 17/18 | (2006.01) |

(52) U.S. Cl.
CPC .............. *C12N 9/0028* (2013.01); *C12P 13/001* (2013.01); *C12P 13/02* (2013.01); *C12P 13/04* (2013.01); *C12P 13/06* (2013.01); *C12P 17/10* (2013.01); *C12P 17/12* (2013.01); *C12P 17/165* (2013.01); *C12P 17/185* (2013.01); *C12P 17/188* (2013.01); *C12Y 105/01023* (2013.01); *C12Y 105/01024* (2013.01); *C12Y 105/01028* (2013.01)

(58) Field of Classification Search
CPC ..... C12N 9/0028; C12P 13/001; C12P 13/02; C12P 13/04; C12P 13/06; C12P 17/10; C12P 17/12; C12P 17/165; C12P 17/185; C12P 17/188; C12Y 105/01023; C12Y 105/01024; C12Y 105/01028
See application file for complete search history.

(56) References Cited

U.S. PATENT DOCUMENTS

| | | | |
|---|---|---|---|
| 7,202,070 | B2 | 4/2007 | Rozzell, Jr. |
| 7,423,195 | B2 | 9/2008 | Sticklen et al. |
| 7,452,704 | B2 | 11/2008 | Esaki et al. |
| 2005/0124040 | A1 | 6/2005 | Esaki et al. |
| 2006/0205045 | A1 | 9/2006 | Esaki et al. |
| 2007/0009995 | A1 | 1/2007 | Bogosian et al. |

OTHER PUBLICATIONS

Branden et al., Introduction to Protein Structure, Garland Publishing Inc., New York, p. 247, 1991.*
Seffernick et al., J. Bacteriol. 183(8):2405-2410, 2001.*
Witkowski et al., Biochemistry 38:11643-11650, 1999.*
Abrahamson, M.J., et al., "Development of an Amine Dehydrogenase for Synthesis of Chiral Amines," Angew. Chem. Intl. Ed., 51:3969-3972 [2012].
Asano, Y., et al., "A New Nad+-Dependent Opine Dehydrogenase from *Arthrobacter* sp. Strain IC," J. Bacterol., 171 (8):4466-4471 [1989].
Baker, P.J., et al., "A role for quaternary structure in the substrate specificity of leucine dehydrogenase," Structure, 3(7):693-705 [1995].
Bevan, M., et al., "Structure and transcription of the nopaline synthase gene region of T-DNA," Nucleic Acids Research, 11(2):369-385 [1983].
Britton, K.L., et al., "Crystallization of *Arthrobacter* sp. strain 1C N-(1-D-carboxyethyl)-L- norvaline dehydrogenase and its complex with NAD+," Acta Cryst., D54:124-126 [1998].
Britton, K.L., et al., "Crystal structure and active site location of N-(1-D-carboxylethyl)-L-norvaline dehydrogenase," Nature Structure Biology, 5(7):593-601 [1998].
Brunhuber, N.M.W., et al., "Rhodococcus L-Phenylalanine Dehydrogenase: Kinetics, Mechanism, and Structural Basis for Catalytic Specifity," Biochemistry, 39:9174-9187 [2000].
Dairi, T., et al., "Cloning, Nucleotide Sequencing, and Expression of an Opine Dehydrogenase Gene from *Arthrobacter* sp. Strain 1C," Applied and Environmental Microbiology, 61(8):3169-3171 [1995].

(Continued)

Primary Examiner — Delia Ramirez
(74) Attorney, Agent, or Firm — Codexis, Inc.

(57) ABSTRACT

The present disclosure provides engineered polypeptides having imine reductase activity, polynucleotides encoding the engineered imine reductases, host cells capable of expressing the engineered imine reductases, and methods of using these engineered polypeptides with a range of ketone and amine substrate compounds to prepare secondary and tertiary amine product compounds.

11 Claims, No Drawings

(56) References Cited

OTHER PUBLICATIONS

Donkersloot, J.A., et al., "Cloning, Expression, Sequence Analysis, and Site-directed Mutagenesis of the Tn5306-encoded N-(Carboxyethyl)ornithine Synthase from Lactococcus lactis K1," J. Bio. Chem., 270(20):12226-12234 [1995].

Endo, N., et al., "Purification, characterization, and cDNA cloning of opine dehydrogenases from the polychaete rockworm Marphysa sanguinea," Comparative Biochemistry and Physiology, Part B, 147:293-307 [2007].

Endo, N., et al., "cDNA cloning and primary structure comparison of tauropine dehydrogenase and beta-alanopine dehydrogenase from the limpet Cellana grata," Fish Sci, 75:1471-1479 [2009.

Goto, M., et al., "Crystal Structures of Delta1-Piperideine-2-carboxylate/Delta1-Pyrroline-2-carboxylate Reductase Belonging to a New Family of NAD(P)H-dependent Oxidoreductases," J. Biol. Chem., 280(49):40875-40884 [2005].

Kan-No, N., et al., "The amino acid sequence of tauropine dehydrogenase from the polychaete Arabella iricolor," Comparative Biochemistry and Physiology, Part B, 140:475-485 [2005].

Kan-No, N., et al., "Tauropine dehydrogenase from the marine sponge Halichondria japonica is a homolog of ornithine cyclodeaminase/mu-crystallin," Comparative Biochemistry and Physiology, Part B, 141:331-339 [2005].

Kato, Y., et al., "Stereoselective synthesis of opine-type secondary amine carboxylic acids by a new enzyme opine dehydrogenase Use of recombinant enzymes," J. Mol. Catalysis B: Enzymatic, 1:151-160 [1996].

Kimura, T., et al., "Complementary DNA Cloning and Molecular Evolution of Opine Dehydrogenases in Some Marine Invertebrates," Mar. Biotechnol., 6:493-502 [2005].

Mihara, H., et al., "N-Methyl-L-amino acid dehydrogenase from Pseudomonas putida: A novel member of an unusual NAD(P)-dependent oxidoreductase superfamily," FEBS Journal, 272:1117-1123 [2005].

Muller, A., et al., "Putative reaction mechanism of heterologously expressed octopine dehydrogenase from the great scallop, Pecten maximus (L)," FEBS Journal, 274:6329-6339 [2007].

Peterson, P.E., et al., "The structure of bovine glutamate dehydrogenase provides insights into the mechanism of allostery," Structure, 7:769-782 [1999].

Plese, B., et al., "Cloning and expression of a tauropine dehydrogenase from the marine sponge Suberites domuncula," Mar Biol, 153:1219-1232 [2008].

Plese, B., et al., "Strombine dehydrogenase in the demosponge Suberites domuncula: Characterization and kinetic properties of the enzyme crucial for anaerobic metabolism," Comparative Biochemistry and Physiology, Part B, 154:102-107 [2009].

Smits, S.H.J., et al., "A Structural Basis for Substrate Selectivity and Stereoselectivity in Octopine Dehydrogenase from Pecten maximus," J. Mol. Biol., 381:200-211 [2008].

Smits, S.H.J., et al., "Insights into the Mechanism of Ligand Binding to Octopine Dehydrogenase from Pecten maximus by NMR and Crystallography," PLoS One, 5(8):1-10 [2010].

UniProt F4A2G3 dated Jun. 28, 2011.

UniProt Q44297 dated Nov. 1, 1996.

Xuan, J.-W., et al., "Overlapping Reading Frames at the LYS5 Locus in the Yeast Yarrowia lipolytica," Molecular and Cellular Biology, 10(9):4795-4806 [1990].

Yip, K.S.P., et al., "The structure of Pyrococcus furiosus glutamate dehydrogenase reveals a key role for ion-pair networks in maintaining enzyme stability at extreme temperatures," Structure, 3(11):1147-1158 [1995].

International Search Report for International Application No. PCT/US2013/040377 dated Jul. 18, 2013.

* cited by examiner

ENGINEERED IMINE REDUCTASES AND METHODS FOR THE REDUCTIVE ANIMATION OF KETONE AND AMINE COMPOUNDS

1. CROSS REFERENCE TO RELATED APPLICATIONS

This application claims benefit under 35 U.S.C. §119(e) of application Ser. No. 61/646,100, filed May 11, 2012, the contents of which are incorporated herein by reference.

2. TECHNICAL FIELD

The disclosure relates to engineered polypeptides having imine reductase activity useful for the conversion of various ketone and amine substrates to secondary and tertiary amine products.

3. REFERENCE TO SEQUENCE LISTING, TABLE OR COMPUTER PROGRAM

The official copy of the Sequence Listing is submitted concurrently with the specification as an ASCII formatted text file via EFS-Web, with a file name of "CX2-120U52_ST25.txt", a creation date of May 8, 2013, and a size of 1,729,414 bytes. The Sequence Listing filed via EFS-Web is part of the specification and is incorporated in its entirety by reference herein.

4. BACKGROUND

Chiral secondary and tertiary amines are important building blocks in pharmaceutical industry. There are no efficient biocatalytic routes known to produce this class of chiral amine compounds. The existing chemical methods use chiral boron reagents or multi step synthesis.

There are a few reports in the literature of the biocatalytic synthesis of secondary amines. Whole cells of the anaerobic bacterium *Acetobacterium woodii* imine reductase activity was reported to reduce benzylidine imines and butylidine imines (Chadha, et al., 2008, Tetrahedron: Asymmetry. 19: 93-96). Another report uses benzaldehyde or butyraldehyde and butyl amine or aniline in aqueous medium using whole cells of *Acetobacterium woodii* (Stephens et al., 2004, Tetrahedron. 60:753-758). *Streptomyces* sp. GF3587 and GF3546 were reported to reduce 2-methyl-1-pyrroline stereoselectively (Mitsukara et al., 2010, Org. Biomol. Chem. 8:4533-4535).

One challenge in developing a biocatalytic route for this type of reaction is the identification of an enzyme class that could be engineered to provide to carry out such reactions efficiently under industrially applicable conditions. Opine dehydrogenases are a class of oxidoreductase that act on CH—NH bonds using NADH or NADPH as co-factor. A native reaction of the opine dehydrogenases is the reductive amination of α-keto acids with amino acids. At least five naturally occurring genes having some homology have been identified that encode enzymes having the characteristic activity of opine dehydrogenase class. These five enzymes include: opine dehydrogenase from *Arthrobactor* Sp. Strain 1C (CENDH); octopine dehydrogenase from *Pecten maximus* (great scallop) (OpDH); ornithine synthase from *Lactococcus lactis* K1 (CEOS); β-alanine opine dehydrogenase from *Cellana grata* (BADH); and tauropine dehydrogenase from *Suberites domuncula* (TauDH). The crystal structure of the opine dehydrogenase CENDH has been determined (see Britton et al., "Crystal structure and active site location of N-(1-D-carboxyethyl)-L-norvaline dehydrogenase," Nat. Struct. Biol. 5(7): 593-601 (1998)). Another enzyme, N-methyl L-amino acid dehydrogenase from *Pseudomonas putida* (NMDH) is known to have activity similar to opine dehydrogenases, reacting with α-keto acids and alkyl amines, but appears to have little or no sequence homology to opine dehydrogenases and amino acid dehydrogenases. NMDH has been characterized as belonging to a new superfamily of NAD(P) dependent oxidoreductase (see e.g., U.S. Pat. No. 7,452,704 B2; Esaki et al., FEBS Journal 2005, 272, 1117-1123).

There is a need in the art for biocatalysts and processes for using them, under industrially applicable conditions, for the synthesis of chiral secondary and tertiary amines.

5. SUMMARY

The present disclosure provides novel biocatalysts and associated methods to use them for the synthesis of chiral secondary and tertiary amines by direct reductive amination using an unactivated ketone and an unactivated amine as substrates. The biocatalysts of the disclosure are engineered polypeptide variants derived from a wild-type gene from *Arthrobacter* Sp. Strain 1C which encodes an opine dehydrogenase having the amino acid sequence of SEQ ID NO: 2. These engineered polypeptides are capable of catalyzing the conversion of a ketone (including unactivated ketone substrates such as cyclohexanone and 2-pentanone) or aldehyde substrate, and a primary or secondary amine substrate (including unactivated amine substrates such as butylamine, aniline, methylamine, and dimethylamine) to form a secondary or tertiary amine product compound. The enzymatic activity of these engineered polypeptides derived from opine dehydrogenases is referred and the engineered enzymes disclosed herein are also referred as "imine reductases" or "IREDs." The general imine reductase activity of the IREDs is illustrated below in Scheme 1.

Scheme 1

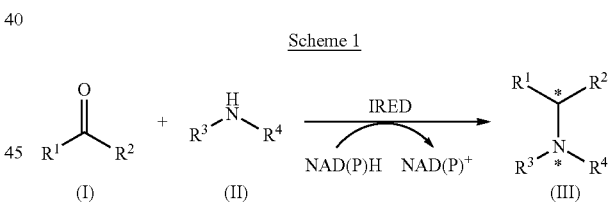

The engineered polypeptides having imine reductase activity of the present disclosure can accept a wide range of substrates. Accordingly, in the biocatalytic reaction of Scheme 1, the $R^1$ and $R^2$ groups of the substrate of formula (I) are independently selected from a hydrogen atom, or optionally substituted alkyl, alkenyl, alkynyl, alkoxy, carboxy, aminocarbonyl, heteroalkyl, heteroalkenyl, heteroalkynyl, carboxyalkyl, aminoalkyl, haloalkyl, alkylthioalkyl, cycloalkyl, aryl, arylalkyl, heterocycloalkyl, heteroaryl, and heteroarylalkyl; and the $R^3$ and $R^4$ groups of the substrate of formula (II) are independently selected from a hydrogen atom, and optionally substituted alkyl, alkenyl, alkynyl, alkoxy, carboxy, aminocarbonyl, heteroalkyl, heteroalkenyl, heteroalkynyl, carboxyalkyl, aminoalkyl, haloalkyl, alkylthioalkyl, cycloalkyl, aryl, arylalkyl, heterocycloalkyl, heteroaryl, and heteroarylalkyl, with the proviso that both $R^3$ and $R^4$ cannot be hydrogen. Optionally, either or both of the $R^1$ and $R^2$ groups of the substrate of formula (I) and the $R^3$ and $R^4$ groups of the substrate of formula (II), can be linked to form a 3-membered to 10-membered ring. Further, the biocatalytic reaction of Scheme 1 can be an intramolecular reaction wherein at least one of the $R^1$ and $R^2$ groups of the compound of formula (I) is linked to at least one of the $R^3$ and $R^4$ groups of the compound of formula (II). Also, either or both of the carbon atom and/or the nitrogen indicated by * in the product compound of formula (III) can be chiral. As described further herein, the engineered polypeptides having imine reductase activity exhibit stereoselectivity, thus, an imine reductase reaction of Scheme 1 can be used to establish one, two, or more, chiral centers of a product compound of formula (III) in a single biocatalytic reaction.

In some embodiments, the present disclosure provides an engineered polypeptide having imine reductase activity, comprising an amino acid sequence having at least 80% sequence identity to a naturally occurring opine dehydrogenase amino acid sequence selected from the group consisting of SEQ ID NO: 2, 102, 104, 106, 108, and 110, and further comprising one or more residue differences as compared to the amino sequence of selected naturally occurring opine dehydrogenase. In some embodiments of the engineered polypeptide derived from an opine dehydrogenase, the imine reductase activity is the activity of Scheme 1, optionally, a reaction as disclosed in Table 2, and optionally, the reaction of converting compound (1b) and compound (2b) to product compound (3d).

In some embodiments, the present disclosure provides an engineered polypeptide having imine reductase activity, comprising an amino acid sequence having at least 80% sequence identity to SEQ ID NO: 2 and one or more residue differences as compared to the sequence of SEQ ID NO: 2 at residue positions selected from: X111, X136, X156, X197, X198, X201, X259, X280, X292, and X293. In some embodiments, the residue differences are selected from X111M/Q/S, X136G, X156G/I/Q/S/T/V, X197I/P, X198A/E/H/P/S, X201L, X259E/H/I/L/M/S/T, X280L, X292C/G/I/P/S/T/V/Y, and X293H/I/K/L/N/Q/T/V. In some embodiments, the engineered polypeptide comprises a residue difference as compared to the sequence of SEQ ID NO: 2 at residue position X198, wherein optionally the residue difference at position X198 is selected from X198A, X198E, X198H, X198P, and X198S. In some embodiments, the engineered polypeptide comprises an amino acid sequence having a residue difference at position X198 that is selected from X198E, and X198H. In some embodiments, the amino acid sequence of the engineered polypeptides comprises at least a combination of residue differences selected from: (a) X111M, X156T, X198H, X259M, X280L, X292V, and X293H; (b) X156T, X197P, X198H, X259H, X280L, X292P, and X293H; (c) X111M, X136G, X156S, X197I, X198H, X201L, X259H, X280L, X292V, and X293H; (d) X197I, X198E, X259M, and X280L; (e) X156T, X197I, X198E, X201L, X259H, X280L, X292V, and X293H; (f) X111M, X136G, X198H, X259M, X280L, X292S, and X293H; and (g) X156V, X197P, X198E, X201L, X259M, X280L, and X292T.

In some embodiments, the present disclosure provides an engineered polypeptide having imine reductase activity, comprising an amino acid sequence having at least 80% sequence identity to SEQ ID NO: 2 and one or more residue differences as compared to the sequence of SEQ ID NO: 2 at residue positions selected from X4, X5, X14, X20, X29, X37, X67, X71, X74, X82, X94, X97, X100, X111, X124, X137, X141, X143, X149, X153, X154, X157, X158, X160, X163, X177, X178, X183, X184, X185, X186, X220, X223, X226, X232, X243, X246, X256, X258, X259, X260, X261, X265, X266, X270, X273, X274, X277, X279, X283, X284, X287, X288, X294, X295, X296, X297, X308, X311, X323, X324, X326, X328, X332, X353, and X356. In some embodiments, these further residue differences are selected from X4H/L/R, X5T, X14P, X20T, X29R/T, X37H, X67A/D, X71C/V, X74R, X82P, X94K/R/T, X97P, X100W, X111R, X124L/N, X137N, X141W, X143W, X149L, X153V/Y, X154F/M/Q/Y, X157D/H/L/M/N/R, X158K, X160N, X163T, X177C/H, X178E, X183C, X184K/Q/R, X185V, X186K/R, X220D/H, X223T, X226L, X232A/R, X243G, X246W, X256V, X258D, X259V/W, X260G, X261A/G/I/K/R/S/T, X265G/L/Y, X266T, X270G, X273W, X274M, X277A/I, X279F/L/V/Y, X283V, X284K/L/M/Y, X287S/T, X288G/S, X294A/I/V, X295R/S, X296L/N/V/W, X297A, X308F, X311C/T/V, X323C/I/M/T/V, X324L/T, X326V, X328A/G/E, X332V, X353E, X356R.

In some embodiments, the present disclosure provides an engineered polypeptide having imine reductase activity, comprising an amino acid sequence having at least 80% sequence identity to SEQ ID NO: 2 and one or more residue differences as compared to the sequence of SEQ ID NO: 2 at residue positions selected from X111, X136, X156, X197, X198, X201, X259, X280, X292, and X293 (as described above), and further comprising at least a combination of residue differences selected from: (a) X29R, X184R, X223T, X261S, X284M, and X287T; (b) X29R, X157R, X184Q, X220H, X223T, X232A, X261I, X284M, X287T, X288S, X324L, X332V, and X353E; (c) X29R, X157R, X184Q, X220H, X223T, X232A, X259V, X261I, X284M, X287T, X288S, X324L, X332V, and X353E; (d) X29R, X94K, X111R, X137N, X157R, X184Q, X220H, X223T, X232A, X259V, X261I, X279V, X284M, X287T, X288S, X324L, X332V, and X353E; and (e) X29R, X94K, X111R, X137N, X157R, X184Q, X220H, X223T, X232A, X259V, X261I, X266T, X279V, X284M, X287T, X288S, X295S, X311V, X324L, X328E, X332V, and X353E.

In some embodiments, the present disclosure provides an engineered polypeptide having imine reductase activity, comprising an amino acid sequence having at least 80% sequence identity to SEQ ID NO: 2 and the combination of residue differences X156T, X197I, X198E, X201L, X259H, X280L, X292V, and X293H, and further comprising one or more residue differences selected from X29R/T, X94K/R/T, X111R, X137N, X157D/H/L/M/N/R, X184K/Q/R, X220D/H, X223T, X232A/R, X259V/W, X261A/G/I/K/R/S/T, X266T, X279F/L/V/Y, X284K/L/M/Y, X287S/T, X288G/S, X295S, X311V, X324L/T, X328E, X332V, and X353E. In some embodiment, the sequence comprises the combination of residue differences X156T, X197I, X198E, X201L, X259H, X280L, X292V, and X293H, and further comprises at least a combination of residue differences selected from: (a) X29R, X184R, X223T, X261S, X284M, and X287T; (b) X29R, X157R, X184Q, X220H, X223T, X232A, X261I, X284M, X287T, X288S, X324L, X332V, and X353E; (c) X29R, X157R, X184Q, X220H, X223T, X232A, X259V, X261I, X284M, X287T, X288S, X324L, X332V, and X353E; (d) X29R, X94K, X111R, X137N, X157R, X184Q, X220H, X223T, X232A, X259V, X261I, X279V, X284M, X287T, X288S, X324L, X332V, and X353E; and (e) X29R, X94K, X111R, X137N, X157R, X184Q, 220H, X223T, X232A, X259V, X261I, X266T, X279V, X284M, X287T, X288S, X295S, X311V, X324L, X328E, X332V, and X353E.

In some embodiments, the engineered polypeptide having imine reductase activity comprises an amino acid sequence having 70%, 80%, 85%, 90%, 95%, 97%, 98%, 99%, or greater identity to a sequence of even-numbered sequence identifiers SEQ ID NO: 4-100 and 112-750.

In another aspect, the present disclosure provides polynucleotides encoding any of the engineered polypeptides having imine reductase activity disclosed herein. Exemplary polynucleotide sequences are provided in the Sequence Listing incorporated by reference herein and include the sequences of odd-numbered sequence identifiers SEQ ID NO: 3-99 and 111-749.

In another aspect, the polynucleotides encoding the engineered polypeptides having imine reductase activity of the disclosure can be incorporated into expression vectors and host cells for expression of the polynucleotides and the corresponding encoded polypeptides. As such, in some embodiments, the present disclosure provides methods of preparing the engineered polypeptides having imine reductase activity by culturing a host cell comprising the polynucleotide or expression vector capable of expressing an engineered polypeptide of the disclosure under conditions suitable for expression of the polypeptide. In some embodiments, the method of preparing the imine reductase polypeptide can comprise the additional step of isolating the expressed polypeptide.

In some embodiments, the present disclosure also provides methods of manufacturing an engineered polypeptide having imine reductase activity, where the method can comprise: (a) synthesizing a polynucleotide encoding a polypeptide comprising an amino acid sequence selected from the even-numbered sequence identifiers of SEQ ID NO: 4-100 and 112-750, and having one or more residue differences as compared to SEQ ID NO:2 at residue positions selected from: X4, X5, X14, X20, X29, X37, X67, X71, X74, X82, X94, X97, X100, X111, X124, X136, X137, X141, X143, X149, X153, X154, X156, X157, X158, X160, X163, X177, X178, X183, X184, X185, X186, X197, X198, X201, X220, X223, X226, X232, X243, X246, X256, X258, X259, X260, X261, X265, X266, X270, X273, X274, X277, X279, X280, X283, X284, X287, X288, X292, X293, X294, X295, X296, X297, X308, X311, X323, X324, X326, X328, X332, X353, and X356, and (b) expressing the engineered polypeptide encoded by the polynucleotide. As noted above, the residue differences at these positions can be selected from X4H/L/R; X5T; X14P; X20T; X29R/T; X37H; X67A/D; X71C/V; X74R; X82P; X94K/R/T; X97P; X100W; X111M/Q/R/S; X124L/N; X136G; X137N; X141W; X143W; X149L; X153V/Y; X154F/M/Q/Y; X156G/I/Q/S/T/V; X157D/H/L/M/N/R; X158K; X160N; X163T; X177C/H; X178E; X183C; X184K/Q/R; X185V; X186K/R; X197I/P; X198A/E/H/P/S; X201L; X220D/H; X223T; X226L; X232A/R; X243G; X246W; X256V; X258D; X259E/H/I/L/M/S/T/V/W; X260G; X261A/G/I/K/R/S/T; X265G/L/Y; X266T; X270G; X273W; X274M; X277A/I; X279F/L/V/Y; X280L; X283V; X284K/L/M/Y; X287S/T; X288G/S; X292C/G/I/P/S/T/V/Y; X293H/I/K/L/N/Q/T/V; X294A/I/V; X295R/S; X296L/N/V/W; X297A; X308F; X311C/T/V; X323C/I/M/T/V; X324L/T; X326V; X328A/G/E; X332V; X353E; and X356R. As further provided in the detailed description, additional variations can be incorporated during the synthesis of the polynucleotide to prepare engineered imine reductase polypeptides with corresponding differences in the expressed amino acid sequences.

In some embodiments, the engineered polypeptides having imine reductase activity of the present disclosure can be used in a biocatalytic process for preparing a secondary or tertiary amine product compound of formula (III),

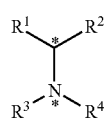

(III)

wherein, $R^1$ and $R^2$ groups are independently selected from optionally substituted alkyl, alkenyl, alkynyl, alkoxy, carboxy, aminocarbonyl, heteroalkyl, heteroalkenyl, heteroalkynyl, carboxyalkyl, aminoalkyl, haloalkyl, alkylthioalkyl, cycloalkyl, aryl, arylalkyl, heterocycloalkyl, heteroaryl, and heteroarylalkyl; and optionally $R^1$ and $R^2$ are linked to form a 3-membered to 10-membered ring; $R^3$ and $R^4$ groups are independently selected from a hydrogen atom, and optionally substituted alkyl, alkenyl, alkynyl, alkoxy, carboxy, aminocarbonyl, heteroalkyl, heteroalkenyl, heteroalkynyl, carboxyalkyl, aminoalkyl, haloalkyl, alkylthioalkyl, cycloalkyl, aryl, arylalkyl, heterocycloalkyl, heteroaryl, and heteroarylalkyl, with the proviso that both $R^3$ and $R^4$ cannot be hydrogen; and optionally $R^3$ and $R^4$ are linked to form a 3-membered to 10-membered ring; and optionally, the carbon atom and/or the nitrogen indicated by * is chiral. The process comprises contacting a compound of formula (I),

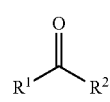

(I)

wherein $R^1$, and $R^2$ are as defined above; and a compound of formula (II),

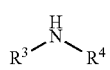

(II)

wherein $R^3$, and $R^4$ are as defined above; with an engineered polypeptide having imine reductase activity in presence of a cofactor under suitable reaction conditions.

In some embodiments of the above biocatalytic process, the engineered polypeptide having imine reductase activity is derived from a naturally occurring enzyme selected from: opine dehydrogenase from *Arthrobacter* sp. strain 1C (SEQ ID NO: 2), D-octopine dehydrogenase from *Pecten maximus* (SEQ ID NO: 102), ornithine dehydrogenase from *Lactococcus lactis* K1 (SEQ ID NO: 104), N-methyl-L-amino acid dehydrogenase from *Pseudomonas putida* (SEQ ID NO: 106), β-alanopine dehydrogenase from *Cellana grata* (SEQ ID NO: 108), and tauropine dehydrogenase from *Suberites domuncula* (SEQ ID NO: 110). In some embodiments, the engineered polypeptide derived from the opine dehydrogenase from *Arthrobacter* sp. strain 1C of SEQ ID NO: 2. Any of the engineered imine reductases described herein (and exemplified by the engineered imine reductase polypeptides of even numbered sequence identifiers SEQ ID NO: 4-100 and 112-750) can be used in the biocatalytic processes for preparing a secondary or tertiary amine compound of formula (III).

In some embodiments of the process for preparing a product compound of formula (III) using an engineered imine reductase, the process further comprises a cofactor regeneration system capable of converting NADP$^+$ to NADPH, or NAD$^+$ to NADH. In some embodiments, the cofactor recycling system comprises formate and formate dehydrogenase (FDH), glucose and glucose dehydrogenase (GDH), glucose-6-phosphate and glucose-6-phosphate dehydrogenase, a secondary alcohol and alcohol dehydrogenase, or phosphite and phosphite dehydrogenase. In some embodiments, the process can be carried out, wherein the engineered imine reductase is immobilized on a solid support.

6. DETAILED DESCRIPTION

As used in this specification and the appended claims, the singular forms "a", "an" and "the" include plural referents unless the context clearly indicates otherwise. Thus, for example, reference to "a polypeptide" includes more than one polypeptide. Similarly, "comprise," "comprises," "comprising" "include," "includes," and "including" are interchangeable and not intended to be limiting. It is to be understood that where descriptions of various embodiments use the term "comprising," those skilled in the art would understand that in some specific instances, an embodiment can be alternatively described using language "consisting essentially of" or "consisting of." It is to be further understood that where descriptions of various embodiments use the term "optional" or "optionally" the subsequently described event or circumstance may or may not occur, and that the description includes instances where the event or circumstance occurs and instances in which it does not. It is to be understood that both the foregoing general description, and the following detailed description are exemplary and explanatory only and are not restrictive of this disclosure. The section headings used herein are for organizational purposes only and not to be construed as limiting the subject matter described.

6.1 Abbreviations

The abbreviations used for the genetically encoded amino acids are conventional and are as follows:

| Amino Acid | Three-Letter Abbreviation | One-Letter Abbreviation |
| --- | --- | --- |
| Alanine | Ala | A |
| Arginine | Arg | R |
| Asparagine | Asn | N |
| Aspartate | Asp | D |
| Cysteine | Cys | C |
| Glutamate | Glu | E |
| Glutamine | Gln | Q |
| Glycine | Gly | G |
| Histidine | HIS | H |
| Isoleucine | Ile | I |
| Leucine | Leu | L |
| Lysine | Lys | K |
| Methionine | Met | M |
| Phenylalanine | Phe | F |
| Proline | Pro | P |
| Serine | Ser | S |
| Threonine | Thr | T |
| Tryptophan | Trp | W |
| Tyrosine | Tyr | Y |
| Valine | Val | V |

When the three-letter abbreviations are used, unless specifically preceded by an "L" or a "D" or clear from the context in which the abbreviation is used, the amino acid may be in either the L- or D-configuration about α-carbon ($C_\alpha$). For example, whereas "Ala" designates alanine without specifying the configuration about the α-carbon, "D-Ala" and "L-Ala" designate D-alanine and L-alanine, respectively. When the one-letter abbreviations are used, upper case letters designate amino acids in the L-configuration about the α-carbon and lower case letters designate amino acids in the D-configuration about the α-carbon. For example, "A" designates L-alanine and "a" designates D-alanine. When polypeptide sequences are presented as a string of one-letter or three-letter abbreviations (or mixtures thereof), the sequences are presented in the amino (N) to carboxy (C) direction in accordance with common convention.

The abbreviations used for the genetically encoding nucleosides are conventional and are as follows: adenosine (A); guanosine (G); cytidine (C); thymidine (T); and uridine (U). Unless specifically delineated, the abbreviated nucleotides may be either ribonucleosides or 2'-deoxyribonucleosides. The nucleosides may be specified as being either ribonucleosides or 2'-deoxyribonucleosides on an individual basis or on an aggregate basis. When nucleic acid sequences are presented as a string of one-letter abbreviations, the sequences are presented in the 5' to 3' direction in accordance with common convention, and the phosphates are not indicated.

6.2 Definitions

In reference to the present disclosure, the technical and scientific terms used in the descriptions herein will have the meanings commonly understood by one of ordinary skill in the art, unless specifically defined otherwise. Accordingly, the following terms are intended to have the following meanings:

"Protein", "polypeptide," and "peptide" are used interchangeably herein to denote a polymer of at least two amino acids covalently linked by an amide bond, regardless of length or post-translational modification (e.g., glycosylation, phosphorylation, lipidation, myristilation, ubiquitination, etc.). Included within this definition are D- and L-amino acids, and mixtures of D- and L-amino acids.

"Polynucleotide" or "nucleic acid" refers to two or more nucleosides that are covalently linked together. The polynucleotide may be wholly comprised ribonucleosides (i.e., an RNA), wholly comprised of 2' deoxyribonucleotides (i.e., a DNA) or mixtures of ribo- and 2' deoxyribonucleosides. While the nucleosides will typically be linked together via standard phosphodiester linkages, the polynucleotides may include one or more non-standard linkages. The polynucleotide may be single-stranded or double-stranded, or may include both single-stranded regions and double-stranded regions. Moreover, while a polynucleotide will typically be composed of the naturally occurring encoding nucleobases (i.e., adenine, guanine, uracil, thymine and cytosine), it may include one or more modified and/or synthetic nucleobases, such as, for example, inosine, xanthine, hypoxanthine, etc. Preferably, such modified or synthetic nucleobases will be encoding nucleobases.

"Opine dehydrogenase activity," as used herein, refers to an enzymatic activity in which a carbonyl group of a 2-ketoacid (e.g., pyruvate) and an amino group of a neutral L-amino acid (e.g., L-norvaline) are converted to a secondary amine dicarboxylate compound (e.g., such as N-[1-(R)-(carboxy)ethyl]-(S)-norvaline).

"Opine dehydrogenase," as used herein refers to an enzyme having opine dehydrogenase activity. Opine dehydrogenase includes but is not limited to the following naturally occurring enzymes: opine dehydrogenase from *Arthrobacter* Sp. Strain 1C (CENDH) (SEQ ID NO: 2); octopine dehydrogenase from *Pecten maximus* (OpDH) (SEQ ID NO: 102); ornithine synthase from *Lactococcus* lactis K1 (CEOS) (SEQ ID NO:

104); N-methyl L-amino acid dehydrogenase from *Pseudomonas putida* (NMDH) (SEQ ID NO: 106); β-alanopine dehydrogenase from *Cellana grata* (BADH) (SEQ ID NO: 108); tauropine dehydrogenase from *Suberites domuncula* (TauDH) (SEQ ID NO: 110); saccharopine dehydrogenase from *Yarrowia lipolytica* (SacDH) (UniProtKB entry: P38997, entry name: LYS1_YARLI); and D-nopaline dehydrogenase from *Agrobacterium tumefaciens* (strain T37) (UniProtKB entry: P00386, entry name: DHNO_AGRT7).

"Imine reductase activity," as used herein, refers to an enzymatic activity in which a carbonyl group of a ketone or aldehyde and an amino group a primary or secondary amine (wherein the carbonyl and amino groups can be on separate compounds or the same compound) are converted to a secondary or tertiary amine product compound, in the presence of co-factor NAD(P)H, as illustrated in Scheme 1.

"Imine reductase" or "IRED," as used herein, refers to an enzyme having imine reductase activity. It is to be understood that imine reductases are not limited to engineered polypeptides derived from the wild-type opine dehydrogenase from *Arthrobacter* Sp. Strain 1C, but may include other enzymes having imine reductase activity, including engineered polypeptides derived from other opine dehydrogenase enzymes, such as octopine dehydrogenase from *Pecten maximus* (OpDH), ornithine synthase from *Lactococcus* lactis K1 (CEOS), β-alanopine dehydrogenase from *Cellana grata* (BADH), tauropine dehydrogenase from *Suberites domuncula* (TauDH); and N-methyl L-amino acid dehydrogenase from *Pseudomonas putida* (NMDH); or an engineered enzyme derived from a wild-type enzyme having imine reductase activity Imine reductases as used herein include naturally occurring (wild-type) imine reductase as well as non-naturally occurring engineered polypeptides generated by human manipulation.

"Coding sequence" refers to that portion of a nucleic acid (e.g., a gene) that encodes an amino acid sequence of a protein.

"Naturally-occurring" or "wild-type" refers to the form found in nature. For example, a naturally occurring or wild-type polypeptide or polynucleotide sequence is a sequence present in an organism that can be isolated from a source in nature and which has not been intentionally modified by human manipulation.

"Recombinant" or "engineered" or "non-naturally occurring" when used with reference to, e.g., a cell, nucleic acid, or polypeptide, refers to a material, or a material corresponding to the natural or native form of the material, that has been modified in a manner that would not otherwise exist in nature, or is identical thereto but produced or derived from synthetic materials and/or by manipulation using recombinant techniques. Non-limiting examples include, among others, recombinant cells expressing genes that are not found within the native (non-recombinant) form of the cell or express native genes that are otherwise expressed at a different level.

"Percentage of sequence identity" and "percentage homology" are used interchangeably herein to refer to comparisons among polynucleotides and polypeptides, and are determined by comparing two optimally aligned sequences over a comparison window, wherein the portion of the polynucleotide or polypeptide sequence in the comparison window may comprise additions or deletions (i.e., gaps) as compared to the reference sequence for optimal alignment of the two sequences. The percentage may be calculated by determining the number of positions at which the identical nucleic acid base or amino acid residue occurs in both sequences to yield the number of matched positions, dividing the number of matched positions by the total number of positions in the window of comparison and multiplying the result by 100 to yield the percentage of sequence identity. Alternatively, the percentage may be calculated by determining the number of positions at which either the identical nucleic acid base or amino acid residue occurs in both sequences or a nucleic acid base or amino acid residue is aligned with a gap to yield the number of matched positions, dividing the number of matched positions by the total number of positions in the window of comparison and multiplying the result by 100 to yield the percentage of sequence identity. Those of skill in the art appreciate that there are many established algorithms available to align two sequences. Optimal alignment of sequences for comparison can be conducted, e.g., by the local homology algorithm of Smith and Waterman, 1981, Adv. Appl. Math. 2:482, by the homology alignment algorithm of Needleman and Wunsch, 1970, J. Mol. Biol. 48:443, by the search for similarity method of Pearson and Lipman, 1988, Proc. Natl. Acad. Sci. USA 85:2444, by computerized implementations of these algorithms (GAP, BESTFIT, FASTA, and TFASTA in the GCG Wisconsin Software Package), or by visual inspection (see generally, Current Protocols in Molecular Biology, F. M. Ausubel et al., eds., Current Protocols, a joint venture between Greene Publishing Associates, Inc. and John Wiley & Sons, Inc., (1995 Supplement) (Ausubel)). Examples of algorithms that are suitable for determining percent sequence identity and sequence similarity are the BLAST and BLAST 2.0 algorithms, which are described in Altschul et al., 1990, J. Mol. Biol. 215: 403-410 and Altschul et al., 1977, Nucleic Acids Res. 3389-3402, respectively. Software for performing BLAST analyses is publicly available through the National Center for Biotechnology Information website. This algorithm involves first identifying high scoring sequence pairs (HSPs) by identifying short words of length W in the query sequence, which either match or satisfy some positive-valued threshold score T when aligned with a word of the same length in a database sequence. T is referred to as, the neighborhood word score threshold (Altschul et al, supra). These initial neighborhood word hits act as seeds for initiating searches to find longer HSPs containing them. The word hits are then extended in both directions along each sequence for as far as the cumulative alignment score can be increased. Cumulative scores are calculated using, for nucleotide sequences, the parameters M (reward score for a pair of matching residues; always >0) and N (penalty score for mismatching residues; always <0). For amino acid sequences, a scoring matrix is used to calculate the cumulative score. Extension of the word hits in each direction are halted when: the cumulative alignment score falls off by the quantity X from its maximum achieved value; the cumulative score goes to zero or below, due to the accumulation of one or more negative-scoring residue alignments; or the end of either sequence is reached. The BLAST algorithm parameters W, T, and X determine the sensitivity and speed of the alignment. The BLASTN program (for nucleotide sequences) uses as defaults a wordlength (W) of 11, an expectation (E) of 10, M=5, N=−4, and a comparison of both strands. For amino acid sequences, the BLASTP program uses as defaults a wordlength (W) of 3, an expectation (E) of 10, and the BLOSUM62 scoring matrix (see Henikoff and Henikoff, 1989, Proc Natl Acad Sci USA 89:10915). Exemplary determination of sequence alignment and % sequence identity can employ the BESTFIT or GAP programs in the GCG Wisconsin Software package (Accelrys, Madison Wis.), using default parameters provided.

"Reference sequence" refers to a defined sequence used as a basis for a sequence comparison. A reference sequence may be a subset of a larger sequence, for example, a segment of a full-length gene or polypeptide sequence. Generally, a reference sequence is at least 20 nucleotide or amino acid residues in length, at least 25 residues in length, at least 50 residues in length, or the full length of the nucleic acid or polypeptide. Since two polynucleotides or polypeptides may each (1) comprise a sequence (i.e., a portion of the complete sequence) that is similar between the two sequences, and (2) may further comprise a sequence that is divergent between the two sequences, sequence comparisons between two (or more) polynucleotides or polypeptide are typically performed by comparing sequences of the two polynucleotides or polypeptides over a "comparison window" to identify and compare local regions of sequence similarity. In some embodiments, a "reference sequence" can be based on a primary amino acid sequence, where the reference sequence is a sequence that can have one or more changes in the primary sequence. For instance, a "reference sequence based on SEQ ID NO:4 having at the residue corresponding to X14 a valine" or X14V refers to a reference sequence in which the corresponding residue at X14 in SEQ ID NO:4, which is a tyrosine, has been changed to valine.

"Comparison window" refers to a conceptual segment of at least about 20 contiguous nucleotide positions or amino acids residues wherein a sequence may be compared to a reference sequence of at least 20 contiguous nucleotides or amino acids and wherein the portion of the sequence in the comparison window may comprise additions or deletions (i.e., gaps) of 20 percent or less as compared to the reference sequence (which does not comprise additions or deletions) for optimal alignment of the two sequences. The comparison window can be longer than 20 contiguous residues, and includes, optionally 30, 40, 50, 100, or longer windows.

"Substantial identity" refers to a polynucleotide or polypeptide sequence that has at least 80 percent sequence identity, at least 85 percent identity and 89 to 95 percent sequence identity, more usually at least 99 percent sequence identity as compared to a reference sequence over a comparison window of at least 20 residue positions, frequently over a window of at least 30-50 residues, wherein the percentage of sequence identity is calculated by comparing the reference sequence to a sequence that includes deletions or additions which total 20 percent or less of the reference sequence over the window of comparison. In specific embodiments applied to polypeptides, the term "substantial identity" means that two polypeptide sequences, when optimally aligned, such as by the programs GAP or BESTFIT using default gap weights, share at least 80 percent sequence identity, preferably at least 89 percent sequence identity, at least 95 percent sequence identity or more (e.g., 99 percent sequence identity). Preferably, residue positions which are not identical differ by conservative amino acid substitutions.

"Corresponding to", "reference to" or "relative to" when used in the context of the numbering of a given amino acid or polynucleotide sequence refers to the numbering of the residues of a specified reference sequence when the given amino acid or polynucleotide sequence is compared to the reference sequence. In other words, the residue number or residue position of a given polymer is designated with respect to the reference sequence rather than by the actual numerical position of the residue within the given amino acid or polynucleotide sequence. For example, a given amino acid sequence, such as that of an engineered imine reductase, can be aligned to a reference sequence by introducing gaps to optimize residue matches between the two sequences. In these cases, although the gaps are present, the numbering of the residue in the given amino acid or polynucleotide sequence is made with respect to the reference sequence to which it has been aligned.

"Amino acid difference" or "residue difference" refers to a change in the amino acid residue at a position of a polypeptide sequence relative to the amino acid residue at a corresponding position in a reference sequence. The positions of amino acid differences generally are referred to herein as "Xn," where n refers to the corresponding position in the reference sequence upon which the residue difference is based. For example, a "residue difference at position X25 as compared to SEQ ID NO: 2" refers to a change of the amino acid residue at the polypeptide position corresponding to position 25 of SEQ ID NO:2. Thus, if the reference polypeptide of SEQ ID NO: 2 has a valine at position 25, then a "residue difference at position X25 as compared to SEQ ID NO:2" an amino acid substitution of any residue other than valine at the position of the polypeptide corresponding to position 25 of SEQ ID NO: 2. In most instances herein, the specific amino acid residue difference at a position is indicated as "XnY" where "Xn" specified the corresponding position as described above, and "Y" is the single letter identifier of the amino acid found in the engineered polypeptide (i.e., the different residue than in the reference polypeptide). In some embodiments, there more than one amino acid can appear in a specified residue position, the alternative amino acids can be listed in the form XnY/Z, where Y and Z represent alternate amino acid residues. In some instances (e.g., in Tables 3A, 3B, 3C, 3D and 3E), the present disclosure also provides specific amino acid differences denoted by the conventional notation "AnB", where A is the single letter identifier of the residue in the reference sequence, "n" is the number of the residue position in the reference sequence, and B is the single letter identifier of the residue substitution in the sequence of the engineered polypeptide. Furthermore, in some instances, a polypeptide of the present disclosure can include one or more amino acid residue differences relative to a reference sequence, which is indicated by a list of the specified positions where changes are made relative to the reference sequence. The present disclosure includes engineered polypeptide sequences comprising one or more amino acid differences that include either/or both conservative and non-conservative amino acid substitutions.

"Conservative amino acid substitution" refers to a substitution of a residue with a different residue having a similar side chain, and thus typically involves substitution of the amino acid in the polypeptide with amino acids within the same or similar defined class of amino acids. By way of example and not limitation, an amino acid with an aliphatic side chain may be substituted with another aliphatic amino acid, e.g., alanine, valine, leucine, and isoleucine; an amino acid with hydroxyl side chain is substituted with another amino acid with a hydroxyl side chain, e.g., serine and threonine; an amino acid having aromatic side chains is substituted with another amino acid having an aromatic side chain, e.g., phenylalanine, tyrosine, tryptophan, and histidine; an amino acid with a basic side chain is substituted with another amino acid with a basic side chain, e.g., lysine and arginine; an amino acid with an acidic side chain is substituted with another amino acid with an acidic side chain, e.g., aspartic acid or glutamic acid; and a hydrophobic or hydrophilic amino acid is replaced with another hydrophobic or hydrophilic amino acid, respectively. Exemplary conservative substitutions are provided in Table 1 below.

TABLE 1

| Residue | Possible Conservative Substitutions |
|---------|-------------------------------------|
| A, L, V, I | Other aliphatic (A, L, V, I)<br>Other non-polar (A, L, V, I, G, M) |

TABLE 1-continued

| Residue | Possible Conservative Substitutions |
| --- | --- |
| G, M | Other non-polar (A, L, V, I, G, M) |
| D, E | Other acidic (D, E) |
| K, R | Other basic (K, R) |
| N, Q, S, T | Other polar |
| H, Y, W, F | Other aromatic (H, Y, W, F) |
| C, P | None |

"Non-conservative substitution" refers to substitution of an amino acid in the polypeptide with an amino acid with significantly differing side chain properties. Non-conservative substitutions may use amino acids between, rather than within, the defined groups and affects (a) the structure of the peptide backbone in the area of the substitution (e.g., proline for glycine), (b) the charge or hydrophobicity, or (c) the bulk of the side chain. By way of example and not limitation, an exemplary non-conservative substitution can be an acidic amino acid substituted with a basic or aliphatic amino acid; an aromatic amino acid substituted with a small amino acid; and a hydrophilic amino acid substituted with a hydrophobic amino acid.

"Deletion" refers to modification to the polypeptide by removal of one or more amino acids from the reference polypeptide. Deletions can comprise removal of 1 or more amino acids, 2 or more amino acids, 5 or more amino acids, 10 or more amino acids, 15 or more amino acids, or 20 or more amino acids, up to 10% of the total number of amino acids, or up to 20% of the total number of amino acids making up the reference enzyme while retaining enzymatic activity and/or retaining the improved properties of an engineered imine reductase enzyme. Deletions can be directed to the internal portions and/or terminal portions of the polypeptide. In various embodiments, the deletion can comprise a continuous segment or can be discontinuous.

"Insertion" refers to modification to the polypeptide by addition of one or more amino acids from the reference polypeptide. In some embodiments, the improved engineered imine reductase enzymes comprise insertions of one or more amino acids to the naturally occurring polypeptide having imine reductase activity as well as insertions of one or more amino acids to other improved imine reductase polypeptides. Insertions can be in the internal portions of the polypeptide, or to the carboxy or amino terminus Insertions as used herein include fusion proteins as is known in the art. The insertion can be a contiguous segment of amino acids or separated by one or more of the amino acids in the naturally occurring polypeptide.

"Fragment" as used herein refers to a polypeptide that has an amino-terminal and/or carboxy-terminal deletion, but where the remaining amino acid sequence is identical to the corresponding positions in the sequence. Fragments can be at least 14 amino acids long, at least 20 amino acids long, at least 50 amino acids long or longer, and up to 70%, 80%, 90%, 95%, 98%, and 99% of the full-length imine reductase polypeptide, for example the polypeptide of SEQ ID NO:2 or engineered imine reductase of SEQ ID NO:96.

"Isolated polypeptide" refers to a polypeptide which is substantially separated from other contaminants that naturally accompany it, e.g., protein, lipids, and polynucleotides. The term embraces polypeptides which have been removed or purified from their naturally-occurring environment or expression system (e.g., host cell or in vitro synthesis). The engineered imine reductase enzymes may be present within a cell, present in the cellular medium, or prepared in various forms, such as lysates or isolated preparations. As such, in some embodiments, the engineered imine reductase enzyme can be an isolated polypeptide.

"Substantially pure polypeptide" refers to a composition in which the polypeptide species is the predominant species present (i.e., on a molar or weight basis it is more abundant than any other individual macromolecular species in the composition), and is generally a substantially purified composition when the object species comprises at least about 50 percent of the macromolecular species present by mole or % weight. Generally, a substantially pure imine reductase composition will comprise about 60% or more, about 70% or more, about 80% or more, about 90% or more, about 95% or more, and about 98% or more of all macromolecular species by mole or % weight present in the composition. In some embodiments, the object species is purified to essential homogeneity (i.e., contaminant species cannot be detected in the composition by conventional detection methods) wherein the composition consists essentially of a single macromolecular species. Solvent species, small molecules (<500 Daltons), and elemental ion species are not considered macromolecular species. In some embodiments, the isolated engineered imine reductase polypeptide is a substantially pure polypeptide composition.

"Stereoselective" refers to a preference for formation of one stereoisomer over another in a chemical or enzymatic reaction. Stereoselectivity can be partial, where the formation of one stereoisomer is favored over the other, or it may be complete where only one stereoisomer is formed. When the stereoisomers are enantiomers, the stereoselectivity is referred to as enantioselectivity, the fraction (typically reported as a percentage) of one enantiomer in the sum of both. It is commonly alternatively reported in the art (typically as a percentage) as the enantiomeric excess (e.e.) calculated therefrom according to the formula [major enantiomer−minor enantiomer]/[major enantiomer+minor enantiomer]. Where the stereoisomers are diastereoisomers, the stereoselectivity is referred to as diastereoselectivity, the fraction (typically reported as a percentage) of one diastereomer in a mixture of two diastereomers, commonly alternatively reported as the diastereomeric excess (d.e.). Enantiomeric excess and diastereomeric excess are types of stereomeric excess.

"Highly stereoselective" refers to a chemical or enzymatic reaction that is capable of converting a substrate or substrates, e.g., substrate compounds (1e) and (2b), to the corresponding amine product, e.g., compound (3i), with at least about 85% stereomeric excess.

"Improved enzyme property" refers to an imine reductase polypeptide that exhibits an improvement in any enzyme property as compared to a reference imine reductase. For the engineered imine reductase polypeptides described herein, the comparison is generally made to the wild-type enzyme from which the imine reductase is derived, although in some embodiments, the reference enzyme can be another improved engineered imine reductase. Enzyme properties for which improvement is desirable include, but are not limited to, enzymatic activity (which can be expressed in terms of percent conversion of the substrate), thermo stability, solvent stability, pH activity profile, cofactor requirements, refractoriness to inhibitors (e.g., substrate or product inhibition), stereospecificity, and stereoselectivity (including enantioselectivity).

"Increased enzymatic activity" refers to an improved property of the engineered imine reductase polypeptides, which can be represented by an increase in specific activity (e.g., product produced/time/weight protein) or an increase in percent conversion of the substrate to the product (e.g., percent conversion of starting amount of substrate to product in a specified time period using a specified amount of imine reductase) as compared to the reference imine reductase enzyme. Exemplary methods to determine enzyme activity are provided in the Examples. Any property relating to enzyme activity may be affected, including the classical enzyme properties of $K_m$, $V_{max}$ or $k_{cat}$, changes of which can lead to increased enzymatic activity. Improvements in enzyme activity can be from about 1.2 times the enzymatic activity of the corresponding wild-type enzyme, to as much as 2 times, 5 times, 10 times, 20 times, 25 times, 50 times or more enzymatic activity than the naturally occurring or another engineered imine reductase from which the imine reductase polypeptides were derived. Imine reductase activity can be measured by any one of standard assays, such as by monitoring changes in properties of substrates, cofactors, or products. In some embodiments, the amount of products generated can be measured by Liquid Chromatography-Mass Spectrometry (LC-MS). Comparisons of enzyme activities are made using a defined preparation of enzyme, a defined assay under a set condition, and one or more defined substrates, as further described in detail herein. Generally, when lysates are compared, the numbers of cells and the amount of protein assayed are determined as well as use of identical expression systems and identical host cells to minimize variations in amount of enzyme produced by the host cells and present in the lysates.

"Conversion" refers to the enzymatic conversion of the substrate(s) to the corresponding product(s). "Percent conversion" refers to the percent of the substrate that is converted to the product within a period of time under specified conditions. Thus, the "enzymatic activity" or "activity" of a imine reductase polypeptide can be expressed as "percent conversion" of the substrate to the product.

"Thermostable" refers to a imine reductase polypeptide that maintains similar activity (more than 60% to 80% for example) after exposure to elevated temperatures (e.g., 40-80° C.) for a period of time (e.g., 0.5-24 hrs) compared to the wild-type enzyme.

"Solvent stable" refers to an imine reductase polypeptide that maintains similar activity (more than e.g., 60% to 80%) after exposure to varying concentrations (e.g., 5-99%) of solvent (ethanol, isopropyl alcohol, dimethylsulfoxide (DMSO), tetrahydrofuran, 2-methyltetrahydrofuran, acetone, toluene, butyl acetate, methyl tert-butyl ether, etc.) for a period of time (e.g., 0.5-24 hrs) compared to the wild-type enzyme.

"Thermo- and solvent stable" refers to an imine reductase polypeptide that is both thermostable and solvent stable.

"Stringent hybridization" is used herein to refer to conditions under which nucleic acid hybrids are stable. As known to those of skill in the art, the stability of hybrids is reflected in the melting temperature ($T_m$) of the hybrids. In general, the stability of a hybrid is a function of ion strength, temperature, G/C content, and the presence of chaotropic agents. The $T_m$ values for polynucleotides can be calculated using known methods for predicting melting temperatures (see, e.g., Baldino et al., Methods Enzymology 168:761-777; Bolton et al., 1962, Proc. Natl. Acad. Sci. USA 48:1390; Bresslauer et al., 1986, Proc. Natl. Acad. Sci. USA 83:8893-8897; Freier et al., 1986, Proc. Natl. Acad. Sci. USA 83:9373-9377; Kierzek et al., Biochemistry 25:7840-7846; Rychlik et al., 1990, Nucleic Acids Res 18:6409-6412 (erratum, 1991, Nucleic Acids Res 19:698); Sambrook et al., supra); Suggs et al., 1981, In Developmental Biology Using Purified Genes (Brown et al., eds.), pp. 683-693, Academic Press; and Wetmur, 1991, Crit. Rev Biochem Mol Biol 26:227-259. All publications incorporate herein by reference). In some embodiments, the polynucleotide encodes the polypeptide disclosed herein and hybridizes under defined conditions, such as moderately stringent or highly stringent conditions, to the complement of a sequence encoding an engineered imine reductase enzyme of the present disclosure.

"Hybridization stringency" relates to hybridization conditions, such as washing conditions, in the hybridization of nucleic acids. Generally, hybridization reactions are performed under conditions of lower stringency, followed by washes of varying but higher stringency. The term "moderately stringent hybridization" refers to conditions that permit target-DNA to bind a complementary nucleic acid that has about 60% identity, preferably about 75% identity, about 85% identity to the target DNA, with greater than about 90% identity to target-polynucleotide. Exemplary moderately stringent conditions are conditions equivalent to hybridization in 50% formamide, 5× Denhart's solution, 5×SSPE, 0.2% SDS at 42° C., followed by washing in 0.2×SSPE, 0.2% SDS, at 42° C. "High stringency hybridization" refers generally to conditions that are about 10° C. or less from the thermal melting temperature $T_m$ as determined under the solution condition for a defined polynucleotide sequence. In some embodiments, a high stringency condition refers to conditions that permit hybridization of only those nucleic acid sequences that form stable hybrids in 0.018M NaCl at 65° C. (i.e., if a hybrid is not stable in 0.018M NaCl at 65° C., it will not be stable under high stringency conditions, as contemplated herein). High stringency conditions can be provided, for example, by hybridization in conditions equivalent to 50% formamide, 5× Denhart's solution, 5×SSPE, 0.2% SDS at 42° C., followed by washing in 0.1×SSPE, and 0.1% SDS at 65° C. Another high stringency condition is hybridizing in conditions equivalent to hybridizing in 5×SSC containing 0.1% (w:v) SDS at 65° C. and washing in 0.1×SSC containing 0.1% SDS at 65° C. Other high stringency hybridization conditions, as well as moderately stringent conditions, are described in the references cited above.

"Heterologous" polynucleotide refers to any polynucleotide that is introduced into a host cell by laboratory techniques, and includes polynucleotides that are removed from a host cell, subjected to laboratory manipulation, and then reintroduced into a host cell.

"Codon optimized" refers to changes in the codons of the polynucleotide encoding a protein to those preferentially used in a particular organism such that the encoded protein is efficiently expressed in the organism of interest. Although the genetic code is degenerate in that most amino acids are represented by several codons, called "synonyms" or "synonymous" codons, it is well known that codon usage by particular organisms is nonrandom and biased towards particular codon triplets. This codon usage bias may be higher in reference to a given gene, genes of common function or ancestral origin, highly expressed proteins versus low copy number proteins, and the aggregate protein coding regions of an organism's genome. In some embodiments, the polynucleotides encoding the imine reductase enzymes may be codon optimized for optimal production from the host organism selected for expression.

"Preferred, optimal, high codon usage bias codons" refers interchangeably to codons that are used at higher frequency in the protein coding regions than other codons that code for the same amino acid. The preferred codons may be determined in relation to codon usage in a single gene, a set of genes of common function or origin, highly expressed genes, the codon frequency in the aggregate protein coding regions of the whole organism, codon frequency in the aggregate protein coding regions of related organisms, or combinations thereof. Codons whose frequency increases with the level of gene expression are typically optimal codons for expression. A variety of methods are known for determining the codon frequency (e.g., codon usage, relative synonymous codon usage) and codon preference in specific organisms, including multivariate analysis, for example, using cluster analysis or correspondence analysis, and the effective number of codons used in a gene (see GCG CodonPreference, Genetics Computer Group Wisconsin Package; CodonW, John Peden, University of Nottingham; McInerney, J. O, 1998, Bioinformatics 14:372-73; Stenico et al., 1994, Nucleic Acids Res. 222437-46; Wright, F., 1990, Gene 87:23-29). Codon usage tables are available for a growing list of organisms (see for example, Wada et al., 1992, Nucleic Acids Res. 20:2111-2118; Nakamura et al., 2000, Nucl. Acids Res. 28:292; Duret, et al., supra; Henaut and Danchin, "*Escherichia coli* and *Salmonella,*" 1996, Neidhardt, et al. Eds., ASM Press, Washington D.C., p. 2047-2066. The data source for obtaining codon usage may rely on any available nucleotide sequence capable of coding for a protein. These data sets include nucleic acid sequences actually known to encode expressed proteins (e.g., complete protein coding sequences-CDS), expressed sequence tags (ESTS), or predicted coding regions of genomic sequences (see for example, Mount, D., Bioinformatics: Sequence and Genome Analysis, Chapter 8, Cold Spring Harbor Laboratory Press, Cold Spring Harbor, N.Y., 2001; Uberbacher, E. C., 1996, Methods Enzymol. 266:259-281; Tiwari et al., 1997, Comput. Appl. Biosci. 13:263-270).

"Control sequence" is defined herein to include all components, which are necessary or advantageous for the expression of a polynucleotide and/or polypeptide of the present disclosure. Each control sequence may be native or foreign to the nucleic acid sequence encoding the polypeptide. Such control sequences include, but are not limited to, a leader, polyadenylation sequence, propeptide sequence, promoter, signal peptide sequence, and transcription terminator. At a minimum, the control sequences include a promoter, and transcriptional and translational stop signals. The control sequences may be provided with linkers for the purpose of introducing specific restriction sites facilitating ligation of the control sequences with the coding region of the nucleic acid sequence encoding a polypeptide.

"Operably linked" is defined herein as a configuration in which a control sequence is appropriately placed (i.e., in a functional relationship) at a position relative to a polynucleotide of interest such that the control sequence directs or regulates the expression of the polynucleotide and/or polypeptide of interest.

"Promoter sequence" refers to a nucleic acid sequence that is recognized by a host cell for expression of a polynucleotide of interest, such as a coding sequence. The promoter sequence contains transcriptional control sequences, which mediate the expression of a polynucleotide of interest. The promoter may be any nucleic acid sequence which shows transcriptional activity in the host cell of choice including mutant, truncated, and hybrid promoters, and may be obtained from genes encoding extracellular or intracellular polypeptides either homologous or heterologous to the host cell.

"Suitable reaction conditions" refer to those conditions in the biocatalytic reaction solution (e.g., ranges of enzyme loading, substrate loading, cofactor loading, temperature, pH, buffers, co-solvents, etc.) under which an imine reductase polypeptide of the present disclosure is capable of converting a substrate compound to a product compound (e.g., conversion of compound (2) to compound (1)). Exemplary "suitable reaction conditions" are provided in the present disclosure and illustrated by the Examples.

"Cofactor regeneration system" or "cofactor recycling system" refers to a set of reactants that participate in a reaction that reduces the oxidized form of the cofactor (e.g., $NADP^+$ to NADPH). Cofactors oxidized by the imine reductase catalyzed reductive amination of the ketone substrate are regenerated in reduced form by the cofactor regeneration system. Cofactor regeneration systems comprise a stoichiometric reductant that is a source of reducing hydrogen equivalents and is capable of reducing the oxidized form of the cofactor. The cofactor regeneration system may further comprise a catalyst, for example an enzyme catalyst that catalyzes the reduction of the oxidized form of the cofactor by the reductant. Cofactor regeneration systems to regenerate NADH or NADPH from $NAD^+$ or $NADP^+$, respectively, are known in the art and may be used in the methods described herein.

"Formate dehydrogenase" and "FDH" are used interchangeably herein to refer to an $NAD^+$ or $NADP^+$-dependent enzyme that catalyzes the conversion of formate and $NAD^+$ or $NADP^+$ to carbon dioxide and NADH or NADPH, respectively.

"Loading", such as in "compound loading" or "enzyme loading" or "cofactor loading" refers to the concentration or amount of a component in a reaction mixture at the start of the reaction.

"Substrate" in the context of a biocatalyst mediated process refers to the compound or molecule acted on by the biocatalyst. For example, an imine reductase biocatalyst used in the reductive amination processes disclosed herein there is a ketone (or aldehyde) substrate of formula (I), such as cyclohexanone, and an amine substrate of formula (II), such as butylamine.

"Product" in the context of a biocatalyst mediated process refers to the compound or molecule resulting from the action of the biocatalyst. For example, an exemplary product for an imine reductase biocatalyst used in a process disclosed herein is a secondary or tertiary amine compound, such as a compound of formula (III).

"Alkyl" refers to saturated hydrocarbon groups of from 1 to 18 carbon atoms inclusively, either straight chained or branched, more preferably from 1 to 8 carbon atoms inclusively, and most preferably 1 to 6 carbon atoms inclusively. An alkyl with a specified number of carbon atoms is denoted in parenthesis, e.g., $(C_1-C_6)$alkyl refers to an alkyl of 1 to 6 carbon atoms.

"Alkylene" refers to a straight or branched chain divalent hydrocarbon radical having from 1 to 18 carbon atoms inclusively, more preferably from 1 to 8 carbon atoms inclusively, and most preferably 1 to 6 carbon atoms inclusively.

"Alkenyl" refers to groups of from 2 to 12 carbon atoms inclusively, either straight or branched containing at least one double bond but optionally containing more than one double bond.

"Alkenylene" refers to a straight or branched chain divalent hydrocarbon radical having 2 to 12 carbon atoms inclusively and one or more carbon-carbon double bonds, more preferably from 2 to 8 carbon atoms inclusively, and most preferably 2 to 6 carbon atoms inclusively.

"Alkynyl" refers to groups of from 2 to 12 carbon atoms inclusively, either straight or branched containing at least one triple bond but optionally containing more than one triple bond, and additionally optionally containing one or more double bonded moieties.

"Cycloalkyl" refers to cyclic alkyl groups of from 3 to 12 carbon atoms inclusively having a single cyclic ring or multiple condensed rings which can be optionally substituted with from 1 to 3 alkyl groups. Exemplary cycloalkyl groups include, but are not limited to, single ring structures such as cyclopropyl, cyclobutyl, cyclopentyl, cyclooctyl, 1-methylcyclopropyl, 2-methylcyclopentyl, 2-methylcyclooctyl, and the like, or multiple ring structures, including bridged ring systems, such as adamantyl, and the like.

"Cycloalkylalkyl" refers to an alkyl substituted with a cycloalkyl, i.e., cycloalkyl-alkyl-groups, preferably having from 1 to 6 carbon atoms inclusively in the alkyl moiety and from 3 to 12 carbon atoms inclusively in the cycloalkyl moiety. Such cycloalkylalkyl groups are exemplified by cyclopropylmethyl, cyclohexylethyl and the like.

"Aryl" refers to an unsaturated aromatic carbocyclic group of from 6 to 12 carbon atoms inclusively having a single ring (e.g., phenyl) or multiple condensed rings (e.g., naphthyl or anthryl). Exemplary aryls include phenyl, pyridyl, naphthyl and the like.

"Arylalkyl" refers to an alkyl substituted with an aryl, i.e., aryl-alkyl-groups, preferably having from 1 to 6 carbon atoms inclusively in the alkyl moiety and from 6 to 12 carbon atoms inclusively in the aryl moiety. Such arylalkyl groups are exemplified by benzyl, phenethyl and the like.

"Heteroalkyl, "heteroalkenyl," and heteroalkynyl," refer to alkyl, alkenyl and alkynyl as defined herein in which one or more of the carbon atoms are each independently replaced with the same or different heteroatoms or heteroatomic groups. Heteroatoms and/or heteroatomic groups which can replace the carbon atoms include, but are not limited to, —O—, —S—, —S—O—, —NR$^\gamma$—, —PH—, —S(O)—, —S(O)NR$^\gamma$—, —S(O)$_2$NR$^\gamma$—, and the like, including combinations thereof, where each R$^\gamma$ is independently selected from hydrogen, alkyl, heteroalkyl, cycloalkyl, heterocycloalkyl, aryl, and heteroaryl.

"Heteroaryl" refers to an aromatic heterocyclic group of from 1 to 10 carbon atoms inclusively and 1 to 4 heteroatoms inclusively selected from oxygen, nitrogen and sulfur within the ring. Such heteroaryl groups can have a single ring (e.g., pyridyl or furyl) or multiple condensed rings (e.g., indolizinyl or benzothienyl).

"Heteroarylalkyl" refers to an alkyl substituted with a heteroaryl, i.e., heteroaryl-alkyl-groups, preferably having from 1 to 6 carbon atoms inclusively in the alkyl moiety and from 5 to 12 ring atoms inclusively in the heteroaryl moiety. Such heteroarylalkyl groups are exemplified by pyridylmethyl and the like.

"Heterocycle", "heterocyclic" and interchangeably "heterocycloalkyl" refer to a saturated or unsaturated group having a single ring or multiple condensed rings, from 2 to 10 carbon ring atoms inclusively and from 1 to 4 hetero ring atoms inclusively selected from nitrogen, sulfur or oxygen within the ring. Such heterocyclic groups can have a single ring (e.g., piperidinyl or tetrahydrofuryl) or multiple condensed rings (e.g., indolinyl, dihydrobenzofuran or quinuclidinyl). Examples of heterocycles include, but are not limited to, furan, thiophene, thiazole, oxazole, pyrrole, imidazole, pyrazole, pyridine, pyrazine, pyrimidine, pyridazine, indolizine, isoindole, indole, indazole, purine, quinolizine, isoquinoline, quinoline, phthalazine, naphthylpyridine, quinoxaline, quinazoline, cinnoline, pteridine, carbazole, carboline, phenanthridine, acridine, phenanthroline, isothiazole, phenazine, isoxazole, phenoxazine, phenothiazine, imidazolidine, imidazoline, piperidine, piperazine, pyrrolidine, indoline and the like.

"Heterocycloalkylalkyl" refers to an alkyl substituted with a heterocycloalkyl, i.e., heterocycloalkyl-alkyl-groups, preferably having from 1 to 6 carbon atoms inclusively in the alkyl moiety and from 3 to 12 ring atoms inclusively in the heterocycloalkyl moiety.

"Oxy" refers to a divalent group —O—, which may have various substituents to form different oxy groups, including ethers and esters.

"Alkoxy" or "alkyloxy" are used interchangeably herein to refer to the group —OR$^\xi$, wherein R$^\xi$ is an alkyl group, including optionally substituted alkyl groups.

"Aryloxy" as used herein refer to the group —OR wherein R is an aryl group as defined above including optionally substituted aryl groups as also defined herein.

"Carboxy" refers to —COOH.

"Carboxyalkyl" refers to an alkyl substituted with a carboxy group.

"Carbonyl" refers to the group —C(O)—. Substituted carbonyl refers to the group R$^\eta$—C(O)—R$^\eta$, where each R$^\eta$ is independently selected from optionally substituted alkyl, cycloalkyl, cycloheteroalkyl, alkoxy, carboxy, aryl, aryloxy, heteroaryl, heteroarylalkyl, acyl, alkoxycarbonyl, sulfanyl, sulfinyl, sulfonyl, and the like. Typical substituted carbonyl groups including acids, ketones, aldehydes, amides, esters, acyl halides, thioesters, and the like.

"Amino" refers to the group —NH$_2$. Substituted amino refers to the group —NHR$^\eta$, NR$^\eta$R$^\eta$, and NR$^\eta$R$^\eta$R$^\eta$, where each R$^\eta$ is independently selected from optionally substituted alkyl, cycloalkyl, cycloheteroalkyl, alkoxy, carboxy, aryl, aryloxy, heteroaryl, heteroarylalkyl, acyl, alkoxycarbonyl, sulfanyl, sulfinyl, sulfonyl, and the like. Typical amino groups include, but are limited to, dimethylamino, diethylamino, trimethylammonium, triethylammonium, methylsulfonylamino, furanyl-oxy-sulfamino, and the like.

"Aminoalkyl" refers to an alkyl group in which one or more of the hydrogen atoms are replaced with an amino group, including a substituted amino group.

"Aminocarbonyl" refers to a carbonyl group substituted with an amino group, including a substituted amino group, as defined herein, and includes amides.

"Aminocarbonylalkyl" refers to an alkyl substituted with an aminocarbonyl group, as defined herein.

"Halogen" or "halo" refers to fluoro, chloro, bromo and iodo.

"Haloalkyl" refers to an alkyl group in which one or more of the hydrogen atoms are replaced with a halogen. Thus, the term "haloalkyl" is meant to include monohaloalkyls, dihaloalkyls, trihaloalkyls, etc. up to perhaloalkyls. For example, the expression "(C$_1$C$_2$) haloalkyl" includes 1-fluoromethyl, difluoromethyl, trifluoromethyl, 1-fluoroethyl, 1,1-difluoroethyl, 1,2-difluoroethyl, 1,1,1 trifluoroethyl, perfluoroethyl, etc.

"Hydroxy" refers to —OH.

"Hydroxyalkyl" refers to an alkyl substituted with one or more hydroxy group.

"Thio" or "sulfanyl" refers to —SH. Substituted thio or sulfanyl refers to —S—R$^\eta$, where R$^\eta$ is an alkyl, aryl or other suitable substituent.

"Alkylthio" refers to —SR$^\xi$, where R$^\xi$ is an alkyl, which can be optionally substituted. Typical alkylthio group include, but are not limited to, methylthio, ethylthio, n-propylthio, and the like.

"Alkylthioalkyl" refers to an alkyl substituted with an alkylthio group, —SR$^\xi$, where R$^\xi$ is an alkyl, which can be optionally substituted.

"Sulfonyl" refers to —SO₂—. Substituted sulfonyl refers to —SO₂—R$^n$, where R$^n$ is an alkyl, aryl or other suitable substituent.

"Alkylsulfonyl" refers to —SO₂—R$^ζ$, where R$^ζ$ is an alkyl, which can be optionally substituted. Typical alkylsulfonyl groups include, but are not limited to, methylsulfonyl, ethylsulfonyl, n-propylsulfonyl, and the like.

"Alkylsulfonylalkyl" refers to an alkyl substituted with an alkylsulfonyl group, —SO₂—R$^ζ$, where R$^ζ$ is an alkyl, which can be optionally substituted.

"Membered ring" is meant to embrace any cyclic structure. The number preceding the term "membered" denotes the number of skeletal atoms that constitute the ring. Thus, for example, cyclohexyl, pyridine, pyran and thiopyran are 6-membered rings and cyclopentyl, pyrrole, furan, and thiophene are 5-membered rings.

"Fused bicyclic ring" refers to both unsubstituted and substituted carbocyclic and/or heterocyclic ring moieties having 5 or 8 atoms in each ring, the rings having 2 common atoms.

"Optionally substituted" as used herein with respect to the foregoing chemical groups means that positions of the chemical group occupied by hydrogen can be substituted with another atom, such as carbon, oxygen, nitrogen, or sulfur, or a chemical group, exemplified by, but not limited to, hydroxy, oxo, nitro, methoxy, ethoxy, alkoxy, substituted alkoxy, trifluoromethoxy, haloalkoxy, fluoro, chloro, bromo, iodo, halo, methyl, ethyl, propyl, butyl, alkyl, alkenyl, alkynyl, substituted alkyl, trifluoromethyl, haloalkyl, hydroxyalkyl, alkoxyalkyl, thio, alkylthio, acyl, carboxy, alkoxycarbonyl, carboxamido, substituted carboxamido, alkylsulfonyl, alkylsulfinyl, alkylsulfonylamino, sulfonamido, substituted sulfonamido, cyano, amino, substituted amino, alkylamino, dialkylamino, aminoalkyl, acylamino, amidino, amidoximo, hydroxamoyl, phenyl, aryl, substituted aryl, aryloxy, arylalkyl, arylalkenyl, arylalkynyl, pyridyl, imidazolyl, heteroaryl, substituted heteroaryl, heteroaryloxy, heteroarylalkyl, heteroarylalkenyl, heteroarylalkynyl, cyclopropyl, cyclobutyl, cyclopentyl, cyclohexyl, cycloalkyl, cycloalkenyl, cycloalkylalkyl, substituted cycloalkyl, cycloalkyloxy, pyrrolidinyl, piperidinyl, morpholino, heterocycle, (heterocycle)oxy, and (heterocycle)alkyl; where preferred heteroatoms are oxygen, nitrogen, and sulfur. Additionally, where open valences exist on these substitute chemical groups they can be further substituted with alkyl, cycloalkyl, aryl, heteroaryl, and/or heterocycle groups, that where these open valences exist on carbon they can be further substituted by halogen and by oxygen-, nitrogen-, or sulfur-bonded substituents, and where multiple such open valences exist, these groups can be joined to form a ring, either by direct formation of a bond or by formation of bonds to a new heteroatom, preferably oxygen, nitrogen, or sulfur. It is further contemplated that the above substitutions can be made provided that replacing the hydrogen with the substituent does not introduce unacceptable instability to the molecules of the present disclosure, and is otherwise chemically reasonable. One of ordinary skill in the art would understand that with respect to any chemical group described as optionally substituted, only sterically practical and/or synthetically feasible chemical groups are meant to be included. Finally, "optionally substituted" as used herein refers to all subsequent modifiers in a term or series of chemical groups. For example, in the term "optionally substituted arylalkyl," the "alkyl" portion and the "aryl" portion of the molecule may or may not be substituted, and for the series "optionally substituted alkyl, cycloalkyl, aryl and heteroaryl," the alkyl, cycloalkyl, aryl, and heteroaryl groups, independently of the others, may or may not be substituted.

6.3 Engineered Imine Reductase (IRED) Polypeptides

The present disclosure provides engineered polypeptides having imine reductase activity, polynucleotides encoding the polypeptides; methods of preparing the polypeptides, and methods for using the polypeptides. Where the description relates to polypeptides, it is to be understood that it also describes the polynucleotides encoding the polypeptides.

As noted above, imine reductases belong to a class of enzymes that catalyze the reductive amination of a ketone substrate and a primary or secondary amine substrate to a secondary or tertiary amine product, as illustrated by Scheme 1 (see above for Scheme and group structures for compounds of formula (I), (II), and (III)).

The opine dehydrogenase from *Arthrobacter* Sp. Strain 1C (also referred to herein as "CENDH") having the amino acid sequence of SEQ ID NO: 2, naturally catalyzes the conversion of ketone substrate, pyruvate and the amino acid substrate, L-2-amino pentanoic acid (or "L-norvaline") to the product (2S)-2-((1-carboxyethyl)amino)pentanoic acid. CENDH also catalyzes the reaction of pyruvate with the amino acid substrates, L-ornithine, and β-alanine, and structurally similar amino sulfonic acid substrate, taurine. In addition, CENDH was found to catalyze the conversion of the unactivated ketone substrate, cyclohexanone (rather than pyruvate) and its natural amine substrate, L-norvaline, to the secondary amine product, (S)-2-(cyclohexylamino)pentanoic acid. CENDH also was found to catalyze the conversion of its natural ketone substrate pyruvate with the primary amines butylamine, ethylamine, and isopropylamine, to their respective 2-(alkylamino)propanoic acid secondary amine products. CENDH, however, did not exhibit any activity for the conversion of pyruvate with secondary amines, such as dimethylamine. Furthermore, CENDH did not show any imine reductase activity with the unactivated ketone substrate, cyclohexanone, when used together with the unactivated primary amine substrate, butylamine.

In the present disclosure, engineered imine reductases are described that overcome the deficiencies of the wild-type opine dehydrogenase CENDH. The engineered imine reductase polypeptides derived from the wild-type enzyme of *Arthrobacter* Sp. Strain 1C are capable of efficiently converting pyruvate and L-norvaline to the product (2S)-2-((1-carboxyethyl)amino)pentanoic acid, but also capable of efficiently converting a range of ketone substrate compounds of formula (I) and amine substrate compounds of formula (II), to the secondary and tertiary amine product compounds of formula (III) as shown by conversion reactions (a) through (o) which are listed below in Table 2.

TABLE 2

| Conversion Reaction ID | Substrate Compound of formula (I) | Substrate Compound of formula (II) | Product Compound(s) of formula (III) |
|---|---|---|---|
| (a) | (1a) pyruvate | L-norvaline (2a) | (3a) |
| (b) | (1a) pyruvate | Butyl amine (2b) | 2-(butylamino)propanoic acid (3b) |
| (c) | (1b) cyclohexanone | L-norvaline (2a) | (3c) |
| (d) | (1b) cyclohexanone | Butyl amine (2b) | (3d) |
| (e) | (1b) cyclohexanone | H$_2$N— (2c) | (3e) |
| (f) | (1b) cyclohexanone | aniline (2d) | (3f) |

TABLE 2-continued

| Conversion Reaction ID | Substrate Compound of formula (I) | Substrate Compound of formula (II) | Product Compound(s) of formula (III) |
|---|---|---|---|
| (g) | cyclopentanone (1c) | L-norvaline (2a) | (3g) |
| (h) | acetophenone (1d) | L-norvaline (2a) | (3h) |
| (i) | 2-methoxycyclohexanone (1e) | Butyl amine (2b) | (3i) |
| (j) | 2-pentanone (1f) | Butyl amine (2b) | (3j) |
| (k) | hydroxyacetone (1g) | (2e) | (3k) |
| (l) | cyclohexanone (1b) | (S)-2-aminopent-4-enoic acid (2f) | (3l) |

TABLE 2-continued

| Conversion Reaction ID | Substrate Compound of formula (I) | Substrate Compound of formula (II) | Product Compound(s) of formula (III) |
|---|---|---|---|
| (m) | (1h) | L-norvaline (2a) | (3m) |
| (n) | (1i) | Butyl amine (2b) | (3n) |
| (o) | (1j) | Butyl amine (2b) | (3o) |

Significantly, the present disclosure identifies amino acid residue positions and corresponding mutations in the CENDH polypeptide of SEQ ID NO: 2 that improve its enzyme properties as compared to the naturally occurring enzyme, including among others, imine reductase activity, substrate specificity, and selectivity. In particular, the present disclosure provides engineered IRED polypeptides capable of catalyzing reductive amination reactions such as those of Table 2, i.e., the reductive amination of ketone substrate compounds of formula (I) (e.g., cyclohexanone) with primary and secondary amine substrate compounds of formula (II) thereby producing secondary or tertiary amine compounds of formula (III).

In some embodiments, the engineered imine reductase polypeptides show an increased activity in the conversion of the ketone substrate of formula (I) and amine substrate of formula (II) to an amine product of formula (III), in a defined time with the same amount of enzyme as compared to the wild-type enzyme, CENDH. In some embodiments, the engineered imine reductase polypeptide has at least about 1.2 fold, 1.5 fold, 2 fold, 3 fold, 4 fold, 5 fold, or 10 fold or more the activity as compared to the wild-type CENDH polypeptide represented by SEQ ID NO:2 under suitable reaction conditions.

In some embodiments, the engineered imine reductase polypeptides exhibit an imine reductase activity in the conversion of a ketone substrate of formula (I) and an amine substrate of formula (II) to an amine product of formula (III), for which the wild-type polypeptide, CENDH, has no detectable activity.

The product compounds of formula (III) produced by the engineered imine reductase polypeptides can be a secondary or tertiary amine compounds having one or more chiral centers. In some embodiments, the engineered imine reductase polypeptides are capable of converting the ketone and amine substrate compounds of formula (I) and formula (II), to a chiral amine product compound of formula (III), in an enantiomeric excess or diastereomeric excess of greater than 90%, 91%, 92%, 93%, 94%, 95%, 96%, 97%, 98%, 99%, 99.5%, or greater.

In some embodiments, the engineered imine reductase polypeptides are capable of converting the ketone and amine substrate compounds of formula (I) and formula (II) with increased tolerance for the presence of one or both of these substrate compounds relative to the tolerance of the reference polypeptide of SEQ ID NO: 2 under suitable reaction conditions. Thus, in some embodiments the engineered imine reductase polypeptides are capable of converting the ketone and amine substrate compounds of formula (I) and formula (II) at a substrate loading concentration of at least about 10 g/L, about 20 g/L, about 30 g/L, about 40 g/L, about 50 g/L, about 70 g/L, about 100 g/L, about 125 g/L, about 150 g/L. about 175 g/L or about 200 g/L or more with a percent conversion of at least about 40%, at least about 50%, at least about 60%, at least about 70%, at least about 80%, at least about 90%, at least about 95%, at least about 98%, or at least about 99%, in a reaction time of about 120 h or less, 72 h or less, about 48 h or less, about 36 h or less, or about 24 h less, under suitable reaction conditions.

The suitable reaction conditions under which the above-described improved properties of the engineered polypeptides carry out the conversion can be determined with respect to concentrations or amounts of polypeptide, substrate, cofactor (e.g., NAD(P)H), coenzyme (e.g., FDH or GDH), buffer, co-solvent, pH, temperature, reaction time, and/or conditions with the polypeptide immobilized on a solid support, as further described below and in the Examples.

The present disclosure provides numerous exemplary engineered polypeptides having imine reductase activity. These exemplary polypeptides were evolved from the wild-type CENDH of SEQ ID NO: 2 and exhibit improved properties, particularly increased activity and stability in the conversion of various ketone and amine substrates, including the conversion of compounds (1b) and (2b) to the amine product compound (3d), the conversion of compounds (1i) and (2b) to the amine product compound (3n), and the conversion of compounds (1j) and (2b) to the amine product compound (3o). These exemplary engineered polypeptides having imine reductase activity have amino acid sequences (provided in the accompanying Sequence Listing as even-numbered sequence identifiers of SEQ ID NO: 4-100, and 112-750) that include one or more residue differences as compared to SEQ ID NO:2 at the following residue positions: X4, X5, X14, X20, X29, X37, X67, X71, X74, X82, X94, X97, X100, X111, X124, X136, X137, X141, X143, X149, X153, X154, X156, X157, X158, X160, X163, X177, X178, X183, X184, X185, X186, X197, X198, X201, X220, X223, X226, X232, X243, X246, X256, X258, X259, X260, X261, X265, X266, X270, X273, X274, X277, X279, X280, X283, X284, X287, X288, X292, X293, X294, X295, X296, X297, X308, X311, X323, X324, X326, X328, X332, X353, and X356. The specific amino acid differences at each of these positions that are associated with the improved properties of the exemplary polypeptides of Tables 3A-3J include: X4H/L/R; X5T; X14P; X20T; X29R/T; X37H; X67A/D; X71C/V; X74R; X82P; X94K/R/T; X97P; X100W; X111M/Q/R/S; X124L/N; X136G; X137N; X141W; X143W; X149L; X153V/Y; X154F/M/Q/Y; X156G/I/Q/S/T/V; X157D/H/L/M/N/R; X158K; X160N; X163T; X177C/H; X178E; X183C; X184K/Q/R; X185V; X186K/R; X197I/P; X198A/E/H/P/S; X201L; X220D/H; X223T; X226L; X232A/R; X243G; X246W; X256V; X258D; X259E/H/I/L/M/S/T/V/W; X260G; X261A/G/I/K/R/S/T; X265G/L/Y; X266T; X270G; X273W; X274M; X277A/I; X279F/L/V/Y; X280L; X283V; X284K/L/M/Y; X287S/T; X288G/S; X292C/G/I/P/S/T/V/Y; X293H/I/K/L/N/Q/T/V; X294A/I/V; X295R/S; X296L/N/V/W; X297A; X308F; X311C/T/V; X323C/I/M/T/V; X324L/T; X326V; X328A/G/E; X332V; X353E; and X356R.

The structure and function information for exemplary non-naturally occurring (or engineered) imine reductase polypeptides of the present disclosure are based on five different high-throughput (HTP) screening assays used in the directed evolution of these enzymes: (1) the conversion of the ketone and amine substrate compounds (1a) and (2b) to the amine product compound (3b); (2) the conversion of the ketone and amine substrate compounds (1b) and (2a) to the amine product compound (3c); (3) the conversion of the ketone and amine substrate compounds (1b) and (2b) to the amine product compound (3d); (4) the conversion of the ketone and amine substrate compounds (1i) and (2b) to the amine product compound (3n); and (5) the conversion of the ketone and amine substrate compounds (1j) and (2b) to the amine product compound (3o). The results of these HTP screening assays which are shown below in Tables 3A, 3B, and 3F-3J. The odd numbered sequence identifiers (i.e., SEQ ID NOs) refer to the nucleotide sequence encoding the amino acid sequence provided by the even numbered SEQ ID NOs, and the sequences are provided in the electronic sequence listing file accompanying this disclosure, which is hereby incorporated by reference herein. The amino acid residue differences listed in Tables 3A, and 3B, are based on comparison to the reference sequence of SEQ ID NO: 2, which is naturally occurring amino acid sequence of the opine dehydrogenase from *Arthrobacter* Sp. Strain 1C, CENDH. The amino acid residue differences listed in Tables 3F-3J, are based on comparison to the reference sequence of SEQ ID NO: 96, which is the amino acid sequence of an engineered polypeptide having the following 7 residue differences as compared to the opine dehydrogenase from *Arthrobacter* Sp. Strain 1C, CENDH: K156T, V197I, N198E, M201L, Y259H, Y280L, R292V, and Y293H.

The activity of the engineered imine reductase polypeptides relative to the reference polypeptide of SEQ ID NO: 2 was determined using one or more of the five high-throughput (HTP) assays as the primary screen: (1) conversion of the substrates pyruvate (compound (1a)) and butylamine (compound (2b)) to the product 2-(butylamino)propanoic acid (compound (3b)); (2) conversion of the substrates cyclohexanone (compound (1b)) and L-norvaline (compound (2a)) to the product (S)-2-(cyclohexylamino)pentanoic acid (compound (3c)); (3) conversion of the substrates cyclohexanone and butylamine to the product N-butylcyclohexanamine (compound (3d)); (4) conversion of the substrates 5-methoxy-3,4-dihydronaphthalen-2(1H)-one (compound OD) and butylamine (compound (2b)) to the secondary amine product N-butyl-5-methoxy-1,2,3,4-tetrahydronaphthalen-2-amine (compound (3n)); and (5) conversion of the substrates 2-(3,4-dimethoxyphenethoxy)cyclohexanone (compound (1j) and butylamine (compound (2b)) to the secondary amine product N-butyl-2-(3,4-dimethoxyphenethoxy)cyclohexanamine (compound (3o)). The HTP assay values in Tables 3A and 3B were determined using *E. coli* clear cell lysates in 96 well-plate format of ~300 μL volume per well following assay reaction conditions as noted in the Tables and the Examples. The HTP assay values in Tables 3F-3J were determined using *E. coli* clear cell lysates in 96 well-plate format of ~100 μL volume per well following assay reaction conditions as noted in the Tables and the Examples.

In some instances, shake flask powder (SFP) assays also were used to assess the activity of the engineered imine reductases, the results of which are provided in Tables 3C and 3D. The SFP preparations provide a more purified powder of the engineered polypeptides that are up to about 30% of total protein. The SFP assay reaction conditions are noted in the Tables and Examples. In addition, Tables 3C, 3D and 3E provide SFP assay results for engineered imine reductase polypeptides when used with other combinations of ketone and amine substrates shown in Table 2, including the ketone substrates, 2-methoxy-cyclohexanone, cyclopentanone, and acetophenone, hydroxyacetone, and the amine substrates, methylamine, dimethylamine, and aniline. The engineered imine reductases were also assayed for their selectivity for certain enantiomeric or diastereomeric products by measuring the ratio of products formed in the reactions, such as the diastereomeric product compounds (3h) and (3i), as shown in Tables 3C and 3E.

TABLE 3A

Engineered Polypeptides and Relative Enzyme Improvements Using HTP Preparations

| SEQ ID NO: (nt/aa) | Amino Acid Differences (relative to SEQ ID NO: 2) | Increased Activity[1] cyclohexanone/ L-norvaline[2] (relative to SEQ ID NO: 2) | Increased Activity[1] pyruvate/ butylamine[3] (relative to SEQ ID NO: 2) |
|---|---|---|---|
| 3/4 | N198A; | ++ | − |
| 5/6 | N198H; | ++++ | − |
| 7/8 | K156I; | − | + |
| 9/10 | V197I; | + | − |
| 11/12 | K156V; | − | ++ |
| 13/14 | Y259T; | − | +++ |
| 15/16 | N198P; | + | − |
| 17/18 | K156T; | − | ++ |
| 19/20 | K156Q; | − | + |
| 21/22 | K156S; | − | ++ |
| 23/24 | Y259S; | − | ++ |
| 25/26 | Y259M; | − | ++ |
| 27/28 | K156G; | − | + |
| 29/30 | S136G; | − | + |
| 31/32 | Y259H; | − | +++ |
| 33/34 | M201L; | + | − |
| 35/36 | Y280L; | − | + |
| 37/38 | Y259I; | − | + |
| 39/40 | N198S; | ++ | − |
| 41/42 | Y259L; | − | + |
| 43/44 | Y259E; | − | + |
| 45/46 | A111S; | − | + |
| 47/48 | Y293T; | +++ | − |
| 49/50 | A111Q; | − | +++ |
| 51/52 | Y293Q; | ++ | − |
| 53/54 | Y293L; | ++ | − |
| 55/56 | R292I; | +++ | − |
| 57/58 | R292V; | +++++ | − |
| 59/60 | Y293V; | +++++ | − |
| 61/62 | R292T; | +++++ | − |
| 63/64 | Y293H; | ++++ | − |
| 65/66 | R292G; | +++ | − |
| 67/68 | R292P; | ++++ | − |
| 69/70 | R292C; | +++ | − |
| 71/72 | R292Y; | +++ | − |
| 73/74 | R292S; | +++++ | − |
| 75/76 | Y293I; | ++++ | − |
| 77/78 | A111M; | + | +++ |
| 79/80 | Y293K; | ++ | − |
| 81/82 | Y293N; | ++ | − |

TABLE 3A-continued

Engineered Polypeptides and Relative Enzyme Improvements Using HTP Preparations

| SEQ ID NO: (nt/aa) | Amino Acid Differences (relative to SEQ ID NO: 2) | Increased Activity[1] cyclohexanone/ L-norvaline[2] (relative to SEQ ID NO: 2) | Increased Activity[1] pyruvate/ butylamine[3] (relative to SEQ ID NO: 2) |
|---|---|---|---|
| 83/84 | V197P; | + | + |
| 85/86 | N198E; | ++ | − |

[1]Levels of increased activity were determined relative to the reference polypeptide of SEQ ID NO: 2 and defined as follows: "−" = activity less than or equal to reference polypeptide; "+" = at least 1.1-fold but less than 2.5-fold increased activity; "++" = at least 2.5-fold but less than 5-fold increased activity; "+++" = at least 5-fold increased activity but less than 10-fold; "++++" = at least 10 fold but less than 15-fold; and "+++++" at least 15-fold but less than 20-fold.

[2]cyclohexanone/L-norvaline assay conditions: E. coli cells expressing the polypeptide variant gene of interest were pelleted, placed in 96-well plates and lysed in 250 μL lysis buffer (1 g/L lysozyme and 1 g/L PMBS in 0.1M phosphate buffer, pH 8.5) with low-speed shaking for 1.5 h on titre-plate shaker at room temperature. The lysate containing plates were centrifuged at 4000 rpm and 4° C. for 10 min and the clear lysate supernatant used for assay reactions. A 40 μL volume of the clear lysate was added to an assay mixture of the substrates cyclohexanone, and norvaline, and the cofactor NADH, in 0.1M phosphate buffer, pH 8.5. The resulting assay reaction mixture was 300 μL in volume in a 96-well plate format and included 20 mM cyclohexanone, 20 mM L-norvaline, and 5 mM NADH. These reaction mixture plates were shaken overnight at high-speed on a titre-plate shaker at room temperature. Each reaction mixture was quenched with 300 μL CH$_3$CN and diluted 10 fold in CH$_3$CN/H$_2$O/formic acid (50/50/0.1). The quenched and diluted reaction mixtures were analyzed by LC-MS in multiple reaction monitoring (MRM) mode. The relevant MS parameters were: [M + H]+: 200; Main fragment ions at CE = 20ev: 154, 118, 83, 72, 55. The MRM transitions used for monitoring product formation: 200/118; 200/72.

[3]pyruvate/butylamine assay conditions: E. coli cells expressing the polypeptide variant gene of interest were pelleted, placed in 96-well plates and lysed in 250 μL lysis buffer (1 g/L lysozyme and 1 g/L PMBS in 0.1M phosphate buffer, pH 8.5) with low-speed shaking for 1.5 h on titre-plate shaker at room temperature. The lysate containing plates were centrifuged at 4000 rpm and 4° C. for 10 min and the clear lysate supernatant used for assay reactions. A 20 μL volume of the clear lysate was added to an assay mixture of the substrates pyruvate, butylamine, and the cofactor NADH, in 0.1M phosphate buffer, pH 8.5. The resulting assay reaction mixture was 300 μL in volume in a 96-well plate format and included 20 mM pyruvate, 20 mM butylamine, and 5 mM NADH. The reaction mixture plates were shaken overnight at high-speed on a titre-plate shaker at room temperature. Each reaction mixture was quenched with 300 μL CH$_3$CN and diluted 10 fold in CH$_3$CN/H$_2$O/formic acid (50/50/0.1). The quenched and diluted reaction mixtures were analyzed by LC-MS in multiple reaction monitoring (MRM) mode. The relevant MS parameters were: [M + H]+: 146; Main fragment ion at CE = 20ev: 100. MRM transitions used for monitoring product formation: 146/100.

TABLE 3B

Engineered Polypeptides and Relative Enzyme Improvements Using HTP Preparations

| SEQ ID NO: (nt/aa) | Amino Acid Differences (relative to SEQ ID NO: 2) | Cyclohexanone/ butylamine Assay[1] Activity Ranking[2] | |
|---|---|---|---|
| | | pH 8.5 | pH 10 |
| 87/88 | A111M; K156T; N198H; Y259M; Y280L; R292V; Y293H; | 1 | 1 |
| 89/90 | K156T; V197P; N198H; Y259H; Y280L; R292P; Y293H; | 4 | n.d.a[3] |
| 91/92 | A111M; S136G; K156S; V197I; N198H; M201L; Y259H; Y280L; R292V; Y293H; | 5 | n.d.a[3] |

TABLE 3B-continued

Engineered Polypeptides and Relative Enzyme Improvements Using HTP Preparations

| SEQ ID NO: (nt/aa) | Amino Acid Differences (relative to SEQ ID NO: 2) | Cyclohexanone/ butylamine Assay[1] Activity Ranking[2] pH 8.5 | pH 10 |
|---|---|---|---|
| 93/94 | V197I; N198E; Y259M; Y280L; | n.d.a[3] | 4 |
| 95/96 | K156T; V197I; N198E; M201L; Y259H; Y280L; R292V; Y293H; | 3 | 3 |
| 97/98 | A111M; S136G; N198H; Y259M; Y280L; R292S; Y293H; | n.d.a[3] | 2 |
| 99/100 | K156V; V197P; N198E; M201L; Y259M; Y280L; R292T; | 2 | n.d.a[3] |

[1]$E.\ coli$ cells expressing the polypeptide variant gene of interest were pelleted, placed in 96-well plates and lysed in 200 μL lysis buffer (1 g/L lysozyme and 1 g/L PMBS in 0.1M phosphate buffer, pH 8.5) with low-speed shaking for 1.5 h on titre-plate shaker at room temperature. The lysate containing plates were centrifuged at 4000 rpm and 4° C. for 20 min and the clear lysate supernatant used for assay reactions. A 200 μL volume of the clear lysate was added to an assay mixture of the substrates cyclohexanone, butylamine, and the cofactor NADH, in 0.1M phosphate buffer, pH 8.5 or pH 10. The resulting assay reaction mixture was 300 μL in volume in a 96-well plate format and included 20 mM cyclohexanone, 20 mM butylamine, and 5 mM NADH. The reaction mixture plates were shaken overnight at high-speed on a titre-plate shaker at room temperature. Each reaction mixture was quenched with 300 μL CH$_3$CN and diluted 10 fold in CH$_3$CN/H$_2$O/formic acid (50/50/0.1). The quenched and diluted reaction mixtures were analyzed by LC-MS in multiple reaction monitoring (MRM) mode. The relevant MS parameters were: [M+H]+: 156; Main fragment ions at CE = 20ev; 83, 74, 55. MRM transitions used for monitoring product formation: 156/83; 156/74; 156/55.

[2]The wild-type reference polypeptide of SEQ ID NO: 2 had no detectable activity with these substrates. Additionally, none of variant polypeptides of Table 3A had detectable activity with these substrates. Thus, for each of the variant polypeptides of SEQ ID NO: 88-100, the activity was assayed at the indicated pH as amount of product detected by LC-MS in the quenched assay reaction mixture and was ranked with "1" indicating greatest activity and "5" indicating least activity.

[3]n.d.a. = no detectable activity

TABLE 3C

Engineered Polypeptides and Relative Activity Improvements Using SFP Enzyme Preparations

| SEQ ID NO: (nt/aa) | Amino Acid Differences (relative to SEQ ID NO: 2) | Increased Activity[1] cyclohexanone/ L-norvaline[2] (relative to SEQ ID NO: 2) | Increased Activity[1] cyclopentanone/ L-norvaline[3] (relative to SEQ ID NO: 2) | Activity Ranking acetophenone/ L-norvaline[4] | Diastereo- selectivity (major/minor) acetophenone/ L-norvaline[4] |
|---|---|---|---|---|---|
| 3/4 | N198A; | 2.8 | not tested | not tested | not tested |
| 5/6 | N198H; | 8.4 | 6.8 | 3 | 11.5 |
| 9/10 | V197I; | 1.7 | not tested | not tested | not tested |
| 15/16 | N198P; | 2.2 | not tested | not tested | not tested |
| 71/72 | R292Y; | 6.5 | 13 | 2 | 4.7 |
| 73/74 | R292S; | 13 | 13 | 1 | 4.2 |

SFP assay reaction initial concentrations: ketone substrate: 50 mM; L-norvaline: 50 mM; engineered polypeptide SFP: 5-10 g/L; NAD: 4.5 mM (3 g/L); sodium formate: 100 mM; formate dehydrogenase (FDH-101): 1 g/L; Buffer: 100 mM potassium phosphate, pH 8.5. SFP assay reaction protocol: To 15 mL vial: (1) Add 0.29 mL of 100 mM potassium phosphate buffer pH 8.5; (2) Add 0.2 mL of 1M sodium formate in 100 mM potassium phosphate buffer, pH 8.5; (3) Add 0.2 mL of NAD 30 g/L in 100 mM potassium phosphate buffer, pH 8.5; (4) Add 0.1 mL of FDH 20 g/L in 100 mM potassium phosphate buffer, pH 8.5; (5) Add 10-20 mg engineered polypeptide SFP dissolved in 1 mL of 100 mM potassium phosphate buffer, pH 8.5; (6) Add 0.2 mL of 0.5M norvaline in 100 mM potassium phosphate buffer, pH 8.5; (7) Add appropriate volume of ketone substrate to get 50 mM final concentration (e.g., 12 μL cyclohexanone); (8) Adjust to pH 8.5 with 1M NaOH; (9) Stir at 900 RPM at 30° C. Final reaction volume: 2 mL.
[3]n.d.a. = no detectable activity

TABLE 3D

Relative Activity Improvements for Various Unactivated Ketone Substrates Using SFP Enzyme Preparations of Engineered Polypeptides

| SEQ ID NO: (nt/aa) | Amino Acid Differences (relative to SEQ ID NO: 2) | Cyclohexanone/ butylamine Assay[1] Activity Ranking[2] | Cyclohexanone/ methylamine Assay[1] Activity Ranking[2] | Cyclohexanone/ aniline Assay[1] Activity Ranking[2] |
|---|---|---|---|---|
| 87/88 | A111M; K156T; N198H; Y259M; Y280L; R292V; Y293H; | 1 | 3 | 3 |
| 89/90 | K156T; V197P; N198H; Y259H; Y280L; R292P; Y293H; | 3 | 4 | 2 |
| 91/92 | A111M; S136G; K156S; V197I; N198H; M201L; Y259H; Y280L; R292V; Y293H; | n.d.a[3] | n.d.a[3] | not tested |
| 93/94 | V197I; N198E; Y259M; Y280L; | n.d.a[3] | n.d.a[3] | not tested |
| 95/96 | K156T; V197I; N198E; M201L; Y259H; Y280L; R292V; Y293H; | 2 | 1 | 1 |
| 97/98 | A111M; S136G; N198H; Y259M; Y280L; R292S; Y293H; | n.d.a[3] | 5 | 4 |

TABLE 3D-continued

Relative Activity Improvements for Various Unactivated Ketone Substrates
Using SFP Enzyme Preparations of Engineered Polypeptides

| SEQ ID NO: (nt/aa) | Amino Acid Differences (relative to SEQ ID NO: 2) | Cyclohexanone/ butylamine Assay[1] Activity Ranking[2] | Cyclohexanone/ methylamine Assay[1] Activity Ranking[2] | Cyclohexanone/ aniline Assay[1] Activity Ranking[2] |
|---|---|---|---|---|
| 99/100 | K156V; V197P; N198E; M201L; Y259M; Y280L; R292T; | 1 | 2 | n.d.a[3] |

[1] SFP assay reaction initial concentrations: ketone substrate: 50 mM; amine substrate: 50 mM; engineered polypeptide SFP: 20-50 g/L; NAD:4.5 mM (3 g/L); sodium formate: 100 mM; formate dehydrogenase (FDH-101; commercially available from Codexis, Inc. Redwood City, California, USA): 1 g/L; Buffer: 100 mM potassium phosphate, pH 8.5. SFP assay reaction protocol: To 15 mL vial: (1) Add 0.29 mL of 100 mM potassium phosphate buffer pH 8.5 (NOTE: if more than 20 g/L enzyme is used, 1.29 mL buffer is added and the enzyme SFP is added to the reaction mixture as a solid); (2) Add 0.2 mL of 1M sodium formate in 100 mM potassium phosphate buffer, pH 8.5; (3) Add 0.2 mL of NAD 30 g/L in 100 mM potassium phosphate buffer, pH 8.5; (4) Add 0.1 mL of FDH 20 g/L in 100 mM potassium phosphate buffer, pH 8.5; (5) Add 40-100 mg enzyme SFP dissolved in 1 mL of 100 mM potassium phosphate buffer, pH 8.5; (6) Add 0.2 mL of 0.5M norvaline in 100 mM potassium phosphate buffer, pH 8.5; (7) Add appropriate volume of ketone substrate to get 50 mM final concentration (e.g., 12 µL cyclohexanone); (8) Adjust to pH 8.5 with 1M NaOH; (9) Stir at 900 RPM at 30° C. Final reaction volume: 2 mL.

[2] The wild-type reference polypeptide of SEQ ID NO: 2 had no detectable activity with these substrates. Additionally, none of variant polypeptides of Table 3A had detectable activity with these substrates. Thus, for each of the variant polypeptides of SEQ ID NO: 88-100, the activity was assayed at the indicated pH as amount of product detected by LC-MS in the quenched assay reaction mixture and was ranked with "1" indicating greatest activity and "5" indicating least activity.

[3] n.d.a. = no detectable activity

TABLE 3E

Relative Activity Improvements for Various Unactivated Ketone Substrates
Using SFP Enzyme Preparations of Engineered Polypeptides

| SEQ ID NO: (nt/aa) | Amino Acid Differences (relative to SEQ ID NO: 2) | 2-Methoxy-cyclohexanone/ butylamine Assay[1] Activity Ranking[2] | Diastereo-selectivity (major/ minor) Ranking | Cyclopentanone/ butylamine Assay[1] Activity Ranking[2] | Hydroxyacetone/ dimethylamine Assay[1] Activity Ranking[2] |
|---|---|---|---|---|---|
| 87/88 | A111M; K156T; N198H; Y259M; Y280L; R292V; Y293H; | 2 | 1 | 3 | 4 |
| 89/90 | K156T; V197P; N198H; Y259H; Y280L; R292P; Y293H; | 3 | 1 | 4 | not tested |
| 91/92 | A111M; S136G; K156S; V197I; N198H; M201L; Y259H; Y280L; R292V; Y293H; | n.d.a[3] | n.d.a[3] | n.d.a[3] | not tested |
| 93/94 | V197I; N198E; Y259M; Y280L; | n.d.a[3] | n.d.a[3] | 4 | not tested |
| 95/96 | K156T; V197I; N198E; M201L; Y259H; Y280L; R292V; Y293H; | 3 | 3 | 2 | not tested |
| 97/98 | A111M; S136G; N198H; Y259M; Y280L; R292S; Y293H; | 1 | 2 | 4 | not tested |
| 99/100 | K156V; V197P; N198E; M201L; Y259M; Y280L; R292T; | 4 | 1 | 1 | 2 |

[1] SFP assay reaction initial concentrations: ketone substrate: 50 mM; amine substrate: 50 mM; engineered polypeptide SFP: 20-50 g/L; NAD: 4.5 mM (3 g/L); sodium formate: 100 mM; formate dehydrogenase (FDH-101; commercially available from Codexis, Inc. Redwood City, California, USA): 1 g/L; Buffer: 100 mM potassium phosphate, pH 8.5. SFP assay reaction protocol: To 15 mL vial: (1) Add 0.29 mL of 100 mM potassium phosphate buffer pH 8.5 (NOTE: if more than 20 g/L enzyme is used, 1.29 mL buffer is added and the enzyme SFP is added to the reaction mixture as a solid); (2) Add 0.2 mL of 1M sodium formate in 100 mM potassium phosphate buffer, pH 8.5; (3) Add 0.2 mL of NAD 30 g/L in 100 mM potassium phosphate buffer, pH 8.5; (4) Add 0.1 mL of FDH 20 g/L in 100 mM potassium phosphate buffer, pH 8.5; (5) Add 40-100 mg enzyme SFP dissolved in 1 mL of 100 mM potassium phosphate buffer, pH 8.5; (6) Add 0.2 mL of 0.5M norvaline in 100 mM potassium phosphate buffer, pH 8.5; (7) Add appropriate volume of ketone substrate to get 50 mM final concentration (e.g., 12 µL cyclohexanone); (8) Adjust to pH 8.5 with 1M NaOH; (9) Stir at 900 RPM at 30° C. Final reaction volume: 2 mL.

[2] The wild-type reference polypeptide of SEQ ID NO: 2 had no detectable activity with these substrates. Additionally, none of variant polypeptides of Table 3A had detectable activity with these substrates. Thus, for each of the variant polypeptides of SEQ ID NO: 88-100, the activity was assayed at the indicated pH as amount of product detected by LC-MS in the quenched assay reaction mixture and was ranked with "1" indicating greatest activity and "5" indicating least activity. Variants with the same activity ranking were given the same number.

[3] n.d.a. = no detectable activity

TABLE 3F

Engineered Polypeptides and Relative Enzyme Improvements Using HTP Preparations

| SEQ ID NO: (nt/aa) | Amino Acid Differences (Relative to SEQ ID NO: 96) | Increased Activity[1] (compound (1i) assay[2]) | Increased Activity[1] (compound (1j) assay[3]) |
|---|---|---|---|
| 111/112 | A284M; | ++++ | ++ |
| 113/114 | D324T; | ++ | + |
| 115/116 | D160N; | ++++ | + |
| 117/118 | V184R; | ++ | + |
| 119/120 | V186R; | +++ | + |
| 121/122 | G157L; | ++ | − |
| 123/124 | G157N; | ++ | + |
| 125/126 | S232A; | + | + |
| 127/128 | N288G; | + | − |
| 129/130 | Q220D; | ++ | + |
| 131/132 | A284L; | + | + |
| 133/134 | L223T; | ++ | + |
| 135/136 | E261A; | ++ | + |
| 137/138 | A243G; F294V; | ++ | − |
| 139/140 | N288S; | ++ | ++ |
| 141/142 | G157M; | ++ | + |
| 143/144 | I287T; | ++ | ++ |
| 145/146 | V184K; | ++ | + |
| 147/148 | A284Y; | + | − |
| 149/150 | E261K; | +++ | + |
| 151/152 | E261S; | ++ | + |
| 153/154 | E261I; | ++ | + |
| 155/156 | A158K; | + | + |
| 157/158 | D324L; | ++ | ++ |
| 159/160 | E261T; | +++ | + |
| 161/162 | E261G; I287T; | ++ | ++ |
| 163/164 | Q149L; | ++ | − |
| 165/166 | S178E; | ++ | − |
| 167/168 | K260G; | ++ | − |
| 169/170 | V184Q; | + | + |
| 171/172 | A284K; | ++ | − |
| 173/174 | G157D; K246W; | + | − |
| 175/176 | S29R; | + | + |
| 177/178 | S100W; | ++ | − |
| 179/180 | S356R; | ++ | + |
| 181/182 | S67D; | ++ | − |
| 183/184 | S232R; | ++ | + |
| 185/186 | I287S; | + | + |
| 187/188 | T332V; | + | + |
| 189/190 | V186K; | ++ | + |
| 191/192 | E261R; | +++ | ++ |
| 193/194 | G157R; | ++ | + |
| 195/196 | S67A; S232R; | + | + |
| 197/198 | A311V; | ++ | + |
| 199/200 | G353E; | + | + |
| 201/202 | F295R; | + | − |
| 203/204 | S29R; V184R; L223T; E261A; I287T; N288S; | n.d. | +++++ |
| 205/206 | S29R; S67D; V186R; L223T; E261R; N288S; | n.d. | ++++ |
| 207/208 | S29R; S67D; G157R; V186R; Q220D; L223T; E261A; N288S; | n.d. | +++++ |
| 209/210 | S67D; V184R; L223T; E261R; I287T; N288G; A311V; | n.d. | +++ |
| 211/212 | S29R; S67D; G157R; V184R; V186K; A284M; N288S; D324T; | n.d. | +++ |
| 213/214 | S29R; G157R; D160N; V186K; Q220D; L223T; A284M; I287T; | n.d. | ++++ |
| 215/216 | S29R; G157R; E261K; I287T; | n.d. | ++++ |
| 217/218 | S67D; G157R; V186K; Q220D; I287T; N288G; A311V; | n.d. | +++ |
| 219/220 | S29R; G157R; V184R; Q220D; E261K; N288S; A311V; | n.d. | ++++ |
| 221/222 | S67D; V184R; V186R; L223T; E261A; A284M; N288S; | n.d. | +++ |
| 223/224 | S29R; S67D; G157R; V186R; L223T; A284M; I287T; N288G; | n.d. | ++++ |
| 225/226 | S29R; L223T; E261K; I287T; A311V; | n.d. | +++++ |
| 227/228 | S29R; S67D; D160N; V186K; E261R; A284M; | n.d. | ++ |
| 229/230 | S67D; G157R; A185V; V186K; Q220D; E261K; I287T; N288S; A311V; | n.d. | ++++ |
| 231/232 | S29R; S67D; G157R; V184R; V186R; E261A; I287T; N288G; | n.d. | ++ |
| 233/234 | S29R; S67D; G157R; L223T; E261K; N288S; A311V; D324T; | n.d. | +++++ |
| 235/236 | S29R; S67D; G157R; Q220D; L223T; E261K; I287T; N288S; A311V; D324T; | n.d. | +++++ |
| 237/238 | S29R; S67D; D160N; V186K; Q220D; E261A; I287T; N288S; D324T; | n.d. | +++ |
| 239/240 | S29R; S67D; G157R; E261R; I287T; N288S; | n.d. | +++++ |
| 241/242 | S67D; D160N; V186K; E261A; A284M; N288S; A311V; D324T; | n.d. | + |
| 243/244 | S29R; V186K; Q220D; L223T; E261S; I287T; N288G; A311V; D324T; | n.d. | ++++ |
| 245/246 | S29R; S67D; V184R; Q220D; E261A; A284M; N288G; A311V; D324T; | n.d. | ++++ |

TABLE 3F-continued

Engineered Polypeptides and Relative Enzyme Improvements Using HTP Preparations

| SEQ ID NO: (nt/aa) | Amino Acid Differences (Relative to SEQ ID NO: 96) | Increased Activity[1] (compound (1i) assay[2]) | Increased Activity[1] (compound (1j) assay[3]) |
|---|---|---|---|
| 247/248 | S67D; G157R; V184R; V186R; Q220D; L223T; A284M; N288S; | n.d. | ++++ |
| 249/250 | S67D; G157R; D160N; V184R; L223T; E261S; I287T; | n.d. | ++++ |
| 251/252 | S29R; V184R; L223T; E261S; A284M; I287T; | n.d. | +++++ |
| 253/254 | S67D; G157R; V184R; V186K; L223T; E261A; I287T; | n.d. | ++++ |
| 255/256 | S67D; G157R; V184R; V186K; L223T; E261R; N288S; A311V; D324T; | n.d. | +++ |
| 257/258 | V184R; Q220D; E261K; I287T; N288S; | n.d. | ++++ |
| 259/260 | S29R; S67D; G157R; D160N; V186K; E261R; I287T; A311V; | n.d. | +++ |
| 261/262 | S67D; V186K; L223T; E261S; A284M; I287T; N288G; A311V; D324T; | n.d. | +++ |
| 263/264 | S29R; L223T; I287T; N288S; A311V; D324T; | n.d. | +++++ |
| 265/266 | S29R; S67D; G157R; V184R; L223T; E261S; I287T; N288S; | n.d. | +++++ |
| 267/268 | S29R; S67D; G157R; D160N; V186K; L223T; E261K; A284M; N288S; A311V; D324T; | n.d. | +++ |
| 269/270 | S29R; S67D; G157R; V186K; L223T; E261A; I287T; N288S; A311V; | n.d. | ++++ |
| 271/272 | S67D; G157R; D160N; V186R; L223T; E261S; A284M; I287T; N288G; A311V; | n.d. | ++ |
| 273/274 | S67D; D160N; V186R; L223T; A284M; N288G; | n.d. | ++ |
| 275/276 | S67D; G157R; L223T; E261A; I287T; D324T; | n.d. | ++++ |
| 277/278 | S29R; S67D; G157R; V184R; L223T; E261R; A284M; N288S; | n.d. | ++++ |
| 279/280 | S67D; G157R; V184R; V186R; Q220D; E261S; I287T; N288G; | n.d. | +++ |
| 281/282 | S67D; G157R; V186K; E261A; I287T; N288S; D324T; | n.d. | ++++ |
| 283/284 | S67D; G157R; V184R; Q220D; N288S; A311V; | n.d. | ++++ |
| 285/286 | S67D; E261S; N288S; | n.d. | ++ |
| 287/288 | S29R; G157R; D160N; V186K; Q220D; E261S; I287T; | n.d. | ++++ |
| 289/290 | S29R; S67D; G157R; V186R; E261A; I287T; N288S; | n.d. | ++++ |
| 291/292 | S29R; G157R; D160N; V186K; I287T; N288S; | n.d. | ++++ |

[1]Levels of increased activity were determined relative to the reference polypeptide of SEQ ID NO: 96 and defined as follows: "−" = activity less than or equal to reference polypeptide; "+" = at least 1.1-fold but less than 2.5-fold increased activity; "++" = at least 2.5-fold but less than 5-fold increased activity; "+++" = at least 5-fold increased activity but less than 10-fold; "++++" = at least 10 fold but less than 15-fold; and "+++++" at least 15-fold but less than 20-fold.

[2]Substrate compound (1i) activity assay: Enzyme lysate preparation: E. coli cells expressing the polypeptide variant gene of interest were pelleted, placed in 96-well plates and lysed in 150 µL lysis buffer (1 g/L lysozyme and 1 g/L PMBS in 0.1M phosphate buffer, pH 8.5) with low-speed shaking for 1.5 h on titre-plate shaker at room temperature. The lysate containing plates were centrifuged at 4000 rpm and 4° C. for 10 min and the clear lysate supernatant used for assay reactions. HTP assay reaction: The enzyme assay reaction was carried out in a total volume of 250 µL in a 96-well plate format. The assay reaction was initiated by adding the following to each well containing 150 µL of the lysate: (i) 37.5 µL of FDH cofactor recycling pre-mix (pre-mix contains 666.7 mM sodium formate, 20 g/L NADH, 6.66 g/L FDH-101); (ii) 50 µL of butylamine stock solution (500 mM); and 12.5 µL ketone substrate stock solution (1M compound (1i) in DMSO). The resulting assay reaction included 50 mM ketone substrate compound (1i), 100 mM amine substrate butylamine (compound (2b)), 100 mM sodium formate, 3 g/L NADH, 1 g/L FDH-101, 100 mM potassium phosphate, pH 8.5, 5% (v/v) DMSO. The reaction plate was heat-sealed and shaken at 250 rpm overnight (20-24 h) at 35° C. Work-up and analysis: Each reaction mixture was quenched by adding 250 µL CH$_3$CN, shaken, and centrifuged at 4000 rpm and 4° C. for 10 min. 20 µL of the quenched mixture was diluted 10 fold in 180 µL CH$_3$CN/H$_2$O (50/50) with mixing. 10 µL of this 10-fold dilution mixture was then further diluted in 190 µL CH$_3$CN/H$_2$O (50/50) for a total 400 fold diluted mixtures. These mixtures then were analyzed for product compound (3n) formation by LC-MS in MRM mode as described in Example 4.

[3]Substrate compound (1j) activity assay: Enzyme lysate preparation: E. coli cells expressing the polypeptide variant gene of interest were pelleted, placed in 96-well plates and lysed in 250 µL lysis buffer (1 g/L lysozyme and 1 g/L PMBS in 0.1M phosphate buffer, pH 8.5, 50 mM triethanol amine, 100 mM potassium chloride) with low-speed shaking for 1.5 h on titre-plate shaker at room temperature. The lysate containing plates were centrifuged at 4000 rpm and 4° C. for 10 min and the clear lysate supernatant used for assay reactions. HTP assay reaction: The enzyme assay reaction was carried out in a total volume of 250 µL in a 96-well plate format. The assay reaction was initiated by adding the following to each well containing 150 µL of the lysate: (i) 37.5 µL of FDH cofactor recycling pre-mix (pre-mix contains 666.7 mM sodium formate, 20 g/L NAD, 6.66 g/L FDH-101); (ii) 50 µL of butylamine stock solution (500 mM in 100 mM potassium phosphate, 50 mM triethyl amine, 100 mM potassium chloride, pH 8.5); and 12.5 µL ketone substrate stock solution (1M compound (1j) in DMSO). The resulting assay reaction included 50 mM ketone substrate compound (1i), 100 mM amine substrate butylamine (compound (2b)), 100 mM sodium formate, 3 g/L NAD, 1 g/L FDH-101, 50 mM triethyl amine, 100 mM potassium chloride, 100 mM potassium phosphate, pH 8.5, 5% (v/v) DMSO. The reaction plate was heat-sealed and shaken at 250 rpm overnight (20-24 h) at 35° C. Work-up and analysis: Each reaction mixture was quenched by adding 250 µL CH$_3$CN, shaken, and centrifuged at 4000 rpm and 4° C. for 10 min. 20 µL of the quenched mixture was diluted 10 fold in 180 µL CH$_3$CN/H$_2$O (50/50) with mixing. 10 µL of this 10-fold dilution mixture was then further diluted in 190 µL CH$_3$CN/H$_2$O (50/50) for a total 400 fold diluted mixtures. These mixtures then were analyzed for product compound (3o) formation by LC-MS in MRM mode as described in Example 4.

"n.d." = not determined

TABLE 3G

Engineered Polypeptides and Relative Enzyme Improvements Using HTP Preparations

| SEQ ID NO: (nt/aa) | Amino Acid Differences (Relative to SEQ ID NO: 96) | Increased Activity[1] (compound (1j) assay) |
|---|---|---|
| 293/294 | S29R; G157R; V184K; Q220H; L223T; S232A; E261S; A284L; I287T; N288S; T332V; G353E; | ++[2] |
| 295/296 | S29R; S97P; G157R; A158K; V184R; Q220H; L223T; S232A; E261K; A284L; I287T; D324L; T332V; G353E; | ++[2] |
| 297/298 | S29R; G157R; A158K; V184K; Q220D; L223T; S232R; E261R; A284M; I287T; N288S; | +[2] |

TABLE 3G-continued

Engineered Polypeptides and Relative Enzyme Improvements Using HTP Preparations

| SEQ ID NO: (nt/aa) | Amino Acid Differences (Relative to SEQ ID NO: 96) | Increased Activity[1] (compound (1j) assay) |
|---|---|---|
| 299/300 | S29R; V184R; Q220D; L223T; E261S; A284M; I287T; N288S; D324L; G353E; | +[2] |
| 301/302 | S29R; V184Q; Q220H; L223T; S232R; E261R; A284M; I287T; N288S; T332V; G353E; | ++[2] |
| 303/304 | S29R; G157R; V184K; Q220D; L223T; S232A; E261R; A284L; I287T; D324T; G353E; | +[2] |
| 305/306 | S29R; G157R; V184Q; Q220H; L223T; S232R; E261I; A284L; I287T; N288S; | +[2] |
| 307/308 | S29R; G157R; A158K; V184Q; Q220D; L223T; S232R; E261G; I287T; N288S; D324L; T332V; G353E; | +[2] |
| 309/310 | S29R; V184K; Q220D; L223T; S232E; E261S; A284M; I287T; N288S; G353E; | +[2] |
| 311/312 | S29R; G157R; A158K; V184Q; Q220H; L223T; E261R; A284M; I287T; N288S; D324L; T332V; | ++[2] |
| 313/314 | S29R; V184K; Q220H; L223T; S232E; E261I; A284M; I287T; N288S; D324L; G353E; | +[2] |
| 315/316 | S29R; G157R; V184Q; L223T; S232R; E261S; I287T; D324L; T332V; G353E; | ++[2] |
| 317/318 | S29R; G157R; V184R; L223T; S232A; E261S; A284M; I287T; N288S; | +[2] |
| 319/320 | S29R; G157R; A158K; V184K; Q220H; L223T; S232R; E261K; A284M; I287T; N288S; D324T; G353E; | +[2] |
| 321/322 | S29R; V184Q; Q220H; L223T; S232R; E261K; A284L; I287T; N288S; D324L; G353E; | +[2] |
| 323/324 | S29R; V184K; Q220H; L223T; S232R; E261S; A284M; I287T; N288S; D324T; T332V; G353E; | +[2] |
| 325/326 | S29R; G157R; A158K; V184Q; Q220D; L223T; S232A; E261I; I287T; N288S; | +[2] |
| 327/328 | S29R; G157R; V184R; Q220D; L223T; S232A; E261I; A284M; I287T; N288S; | +[2] |
| 329/330 | S29R; G157R; V184R; Q220H; L223T; S232R; E261K; A284L; I287T; N288S; | +[2] |
| 331/332 | S29R; G157R; V184Q; Q220H; L223T; S232A; E261R; A284M; I287T; N288S; G353E; | ++[2] |
| 333/334 | S29R; V184Q; L223T; S232R; E261R; A284L; I287T; T332V; G353E; | +[2] |
| 335/336 | S29R; V184R; Q220D; L223T; E261I; I287T; N288S; D324T; T332V; G353E; | +[2] |
| 337/338 | S29R; G157R; V184Q; Q220H; L223T; S232R; E261S; A284M; I287T; N288S; D324T; | +[2] |
| 339/340 | S29R; V184Q; Q220H; L223T; S232R; E261I; A284L; I287T; N288S; T332V; | +[2] |
| 341/342 | S29R; G157R; V184K; Q220D; L223T; S232A; E261I; A284M; I287T; N288S; G353E; | +[2] |
| 343/344 | S29R; G157R; V184K; L223T; S232R; E261S; A284L; I287T; N288S; D324T; G353E; | +[2] |
| 345/346 | S29R; S97P; G157R; V184Q; Q220H; L223T; E261K; A284M; I287T; N288S; G353E; | ++[2] |
| 347/348 | S29R; G157R; A158K; V184K; Q220D; L223T; S232R; E261I; I287T; N288S; D324T; G353E; | ++[2] |
| 349/350 | S29R; G157R; V184Q; L223T; E261I; A284M; I287T; N288S; | +[2] |
| 351/352 | S29R; V184Q; Q220H; L223T; S232R; E261R; A284M; I287T; N288S; | +[2] |
| 353/354 | S29R; G157R; V184Q; Q220H; L223T; S232A; E261I; A284M; I287T; N288S; D324L; T332V; G353E; | +++[2] |
| 355/356 | S29R; G157M; V184R; L223T; E261A; A284M; I287T; N288G; A311V; S328G; | +[2] |
| 357/358 | S29R; S67A; G157L; V184R; L223T; E261A; A284M; I287T; | +[2] |
| 359/360 | A20T; S29R; Q149L; G157H; V184R; L223T; E261S; A284M; I287T; A311V; | +[2] |
| 361/362 | A20T; S29R; G157L; V184R; L223T; E261A; A284M; I287S; N288G; A311V; | +[2] |
| 363/364 | A20T; S29R; Q149L; G157L; V184R; L223T; E261K; A284M; I287T; N288G; A311V; | +[2] |
| 365/366 | S29R; S67A; G157R; V184R; L223T; E261S; A284M; I287T; N288G; A311V; S356R; | +[2] |
| 367/368 | S29R; Q149L; G157L; V184R; L223T; E261A; A284M; I287T; N288G; A311V; S356R; | +[2] |
| 369/370 | A20T; S29R; S67A; Q149L; G157L; V184R; L223T; E261S; A284M; I287S; N288G; F294I; A311V; | +[2] |
| 371/372 | S29R; S67A; G157R; V184R; L223T; E261A; A284Y; I287T; A311V; S328G; S356R; | +[2] |
| 373/374 | S29R; G157R; V184R; L223T; E261S; A284L; I287T; A311V; | +[2] |
| 375/376 | S29R; Q149L; G157L; V184R; L223T; E261S; A284M; I287T; N288G; A311V; S328G; | +[2] |
| 377/378 | S29R; V184R; L223T; E261S; A284M; I287T; A311V; G353E; | +[2] |
| 379/380 | S29R; V184R; L223T; E261S; A284M; I287T; A311V; | +[2] |
| 381/382 | S29R; G157L V184R; L223T; E261S; A284M; I287T; | +++[3] |
| 383/384 | S4L; S29R; V184R; L223T; E261S; A284M; I287T; | ++[3] |
| 385/386 | K5T; S29R; V184R; L223T; E261S; A284M; I287T; | ++[3] |
| 387/388 | S29R; V184R; L223T; E261S; A284M; I287T; S328A; | +[3] |
| 389/390 | S29R; V184R; L223T; E261S; A284M; I287T; D324L; | +[3] |
| 391/392 | S29R; V184R; L223T; E261S; A284M; I287T; L323T; | +[3] |
| 393/394 | S29R; V184R; L223T; E261S; A284M; I287T; S328G; | +[3] |
| 395/396 | S29R; V184R; L223T; E261S; A284M; I287T; F294V; | +[3] |
| 397/398 | S29R; A154F, V184R; L223T; E261S; A284M; I287T; | +[3] |
| 399/400 | S4H; S29R; A158K; V184R; L223T; E261S; A284M; I287T; | +[3] |
| 401/402 | S4H; S29R; V184R; L223T; E261S; A284M; I287T; | +[3] |

TABLE 3G-continued

Engineered Polypeptides and Relative Enzyme Improvements Using HTP Preparations

| SEQ ID NO: (nt/aa) | Amino Acid Differences (Relative to SEQ ID NO: 96) | Increased Activity[1] (compound (1j) assay) |
|---|---|---|
| 403/404 | S29R; V184R; L223T; E261S; A284M; I287T; | +[3] |
| 405/406 | S29R; V184R; L223T; E261S; A284M; I287T; L323V; | +[3] |
| 407/408 | S29R; V184R; L223T; E261S; Q265G; A284M; I287T; | +[3] |
| 409/410 | S29R; G157R; V184R; L223T; E261S; A284M; I287T; | +[3] |
| 411/412 | S29R; Y183C; V184R; L223T; E261S; A284M; I287T; | +[3] |
| 413/414 | S29R; V184R; L223T; E261S; A284M; I287T; L308F; | +[3] |
| 415/416 | S29R; V184R; L223T; S232E; E261S; A284M; I287T; | +[3] |
| 417/418 | S29R; A154Y; V184R; L223T; E261S; A284M; I287T; | +[3] |
| 419/420 | S29R; V184R; L223T; E261S; Q265Y; A284M; I287T; | +[3] |
| 421/422 | S29R; V184R; L223T; E261S; A284M; I287T; F294A; | +[3] |
| 423/424 | S29R; N94R; V184R; L223T; E261S; A284M; I287T; | +[3] |
| 425/426 | S29R; I155M; V184R; L223T; E261S; A284M; I287T; | +[3] |
| 427/428 | S29R; V184R; L223T; E261S; A284M; I287T; S328E; | +[3] |
| 429/430 | S29R; N94K; V184R; L223T; E261S; A284M; I287T; | +[3] |
| 431/432 | S29R; V184R; L223T; E261S; A284M; I287T; T332V; | +[3] |
| 433/434 | S29R; A154Q; V184R; L223T; E261S; A284M; I287T; | +[3] |
| 435/436 | S29T; V184R; L223T; E261S; A284M; I287T; | +[3] |
| 437/438 | S29R; V184R; L223T; C256V; E261S; A284M; I287T; | +[3] |
| 439/440 | S29R; V184R; L223T; E261S; Q265L; A284M; I287T; | +[3] |
| 441/442 | S29R; V184R; L223T; E261S; A284M; I287T; A311T; | +[3] |

[1]Levels of increased activity were determined relative to the activity of the reference polypeptide of SEQ ID NO: 252 and defined as follows: "+" = at least 1.3-fold but less than 2-fold increased activity; "++" = at least 2-fold but less than 3-fold increased activity; "+++" = at least 3-fold increased activity but less than 5-fold.
[2]Substrate compound (1j) activity assay: Enzyme lysate preparation: E. coli cells expressing the polypeptide variant gene of interest were pelleted, placed in 96-well plates and lysed in 250 μL lysis buffer (1 g/L lysozyme and 1 g/L PMBS in 0.1M phosphate buffer, pH 8.0) with low-speed shaking for 2 h on titre-plate shaker at room temperature. The lysate containing plates were centrifuged at 4000 rpm and 4° C. for 10 min and the clear lysate supernatant used for assay reactions. HTP assay reaction: The enzyme assay reaction was carried out in a total volume of 100 μL in a 96-well plate format. The assay reaction was initiated by adding 55 μL volume of the clarified lysate to 45 μL of an assay mixture comprised of: (i) 50 mM ketone substrate compound (1j) (15 μL of 330 mM ketone substrate stock in DMSO); (ii) 100 mM butylamine (20 μL of 500 mM butylamine stock); and (iii) NADH cofactor recycling system pre-mix (10 μL of a solution of 10 g/L GDH-105, 1M glucose, 30 g/L NAD in 0.1M potassium phosphate buffer, pH 8.5). The resulting assay reaction included 50 mM compound (1j), 100 mM butylamine, 100 mM glucose, 1 g/L glucose dehydrogenase GDH-105, 3 g/L NADH, in 0.1M potassium phosphate, pH 8.0, and 25% (v/v) DMSO. The reaction mixture plates were shaken overnight (16-20 h) at 250 rpm on a titre-plate shaker at 44° C. Work-up and analysis: Each reaction mixture in the plate was quenched with 100 μL CH₃CN, heat-sealed, shaken, and centrifuged at 4000 rpm, 4 C., for 10 min. 20 μL of the quenched reaction was added to 180 uL of 50% acetonitrile with 0.1% trifluoroacetic acid. The diluted reaction mixtures then were analyzed for product compound (3o) formation by LC-MS in MRM mode as described in Example 4..
[3]Substrate compound (1j) activity assay: Lysate preparation, HTP assay reaction, and work-up and analysis were carried out as described directly above (Note 2, Table 3 G) except that 15% (v/v) DMSO was present in the assay reaction.

TABLE 3H

Engineered Polypeptides and Relative Enzyme Improvements Using HTP Preparations

| SEQ ID NO: (nt/aa) | Amino Acid Differences (Relative to SEQ ID NO: 96) | Increased Activity[1] (compound (1j) assay[2]) |
|---|---|---|
| 443/444 | S29R; G157R; V184Q; Q220H; L223T; S232A; E261I; A284M; I287T; N288S; E296L; D324L; T332V; G353E; | +++ |
| 445/446 | S29R; N94K; A154Y; G157R; Y183C; V184Q; Q220H; L223T; S232A; E261I; Q265L; A284M; I287T; N288S; D324L; T332V; G353E; | ++ |
| 447/448 | S29R; G157R; V184Q; Q220H; L223T; S232A; H259V; E261I; A284M; I287T; N288S; D324L; T332V; G353E; | ++ |
| 449/450 | N14P; S29R; G157R; V184Q; Q220H; L223T; S232A; E261I; A284M; I287T; N288S; D324L; T332V; G353E; | ++ |
| 451/452 | S29R; N94K; G157L; Y183C; V184Q; Q220H; L223T; S232A; E261I; A284M; I287T; N288S; D324L; T332V; G353E; | ++ |
| 453/454 | S29R; N94K; A154Y; G157R; V184Q; Q220H; L223T; S232A; E261I; A284M; I287T; N288S; L323V; D324L; T332V; G353E; | ++ |
| 455/456 | S29R; A154Q; G157R; G177H; V184Q; Q220H; L223T; S232R; C256V; E261I; A284M; I287T; N288S; A311V; L323C; D324L; S328E; T332V; G353E; | ++ |
| 457/458 | S29T; A37H; A154Q; G157R; V184Q; Q220H; L223T; S232R; E261I; A284M; I287T; N288S; A311V; D324L; S328A; T332V; G353E; | ++ |
| 459/460 | S29R; G157R; V184Q; Q220H; L223T; S232A; E261I; A284M; I287T; N288S; D324L; T332V; G353E; | ++ |
| 461/462 | S29R; G157R; V184Q; Q220H; L223T; S232A; E261I; A279Y; A284M; I287T; N288S; D324L; T332V; G353E; | ++ |
| 463/464 | S29R; N94K; A154Y; G157L; V184Q; Q220H; L223T; S232A; E261I; Q265Y; A284M; I287T; N288S; D324L; T332V; G353E; | ++ |
| 465/466 | S29R; G157R; V184Q; Q220H; L223T; S232A; E261I; A279V; A284M; I287T; N288S; D324L; T332V; G353E; | ++ |
| 467/468 | S29R; A154M; G157R; G177H; V184Q; Q220H; L223T; S232E; E261I; A284M; I287T; N288S; A311V; D324L; T332V; G353E; | ++ |

TABLE 3H-continued

Engineered Polypeptides and Relative Enzyme Improvements Using HTP Preparations

| SEQ ID NO: (nt/aa) | Amino Acid Differences (Relative to SEQ ID NO: 96) | Increased Activity[1] (compound (1j) assay[2]) |
|---|---|---|
| 469/470 | S4L; S29R; N94K; G157R; Y183C; V184Q; Q220H; L223T; S232A; E261I; A284M; I287T; N288S; D324L; T332V; G353E; | ++ |
| 471/472 | S29R; G157R; V184Q; Q220H; L223T; S232A; E261I; A279F; A284M; I287T; N288S; D324L; T332V; G353E; | + |
| 473/474 | S29R; A111R; G157R; V184Q; Q220H; L223T; S232A; E261I; A284M; I287T; N288S; D324L; T332V; G353E; | + |
| 475/476 | S29R; N94K; G157R; Y183C; V184Q; Q220H; L223T; S232A; E261I; Q265L; A284M; I287T; N288S; D324L; T332V; G353E; | + |
| 477/478 | S29R; E124L; A154F; I155M; G157R; V184Q; Q220H; L223T; S232R; E261I; A284M; I287T; N288S; A311T; D324L; T332V; G353E; | + |
| 479/480 | S29R; A37H; E124N; A154F; I155M; G157R; G177H; V184Q; Q220H; L223T; S232A; E261I; A284M; I287T; N288S; A311V; L323C; D324L; S328E; T332V; G353E; | + |
| 481/482 | S29R; E124N; I155M; G157R; V184Q; Q220H; L223T; S232A; E261I; A284M; I287T; N288S; D324L; S328E; T332V; G353E; | + |
| 483/484 | S29R; N94K; G157R; Y183C; V184Q; Q220H; L223T; S232A; E261I; Q265L; A284M; I287T; N288S; F294A; L308F; D324L; T332V; G353E; | + |
| 485/486 | S29R; N94K; G157L; V184Q; Q220H; L223T; S232A; E261I; Q265Y; A284M; I287T; N288S; D324L; T332V; G353E; | + |
| 487/488 | S29R; N94R; G157R; V184Q; Q220H; L223T; S232A; E261I; A284M; I287T; N288S; D324L; T332V; G353E; | + |
| 489/490 | S29R; N94K; G157L; Y183C; V184Q; Q220H; L223T; S232A; E261I; Q265G; A284M; I287T; N288S; D324L; T332V; G353E; | + |
| 491/492 | S29R; E124L; I155M; G157R; V184Q; Q220H; L223T; S232A; E261I; A284M; I287T; N288S; A311T; D324L; T332V; G353E; | + |
| 493/494 | S29R; G157R; V184Q; Q220H; L223T; S232A; E261I; A284M; I287T; N288S; D297A; D324L; T332V; G353E; | + |
| 495/496 | S29R; A154Q; G157R; V184Q; Q220H; L223T; S232A; E261I; A284M; I287T; N288S; A311T; D324L; T332V; G353E; | + |
| 497/498 | S29R; A154F; I155M; G157R; G177H; V184Q; Q220H; L223T; S232A; E261I; A284M; I287T; N288S; D324L; T332V; G353E; | + |
| 499/500 | S29R; A154F; G157R; V184Q; Q220H; L223T; S232R; E261I; A284M; I287T; N288S; A311C; D324L; T332V; G353E; | + |
| 501/502 | S29R; A37H; A154F; I155M; G157R; V184Q; Q220H; L223T; S232R; C256V; E261I; A284M; I287T; N288S; A311V; D324L; S328G; T332V; G353E; | + |
| 503/504 | S29R; N94K; G157M; V184Q; Q220H; L223T; S232A; E261I; Q265L; A284M; I287T; N288S; L308F; D324L; T332V; G353E; | + |
| 505/506 | S29R; A37H; E124L; A154Q; I155M; G157R; V184Q; Q220H; L223T; S232A; E261I; A284M; I287T; N288S; A311V; D324L; T332V; G353E; | + |
| 507/508 | S29R; A154M; G157R; V184Q; Q220H; L223T; S232R; C256V; E261I; A284M; I287T; N288S; A311V; D324L; S328E; T332V; G353E; | + |
| 509/510 | S29R; G157R; V184Q; Q220H; L223T; S232A; W258D; E261I; A284M; I287T; N288S; D324L; T332V; G353E; | + |
| 511/512 | S29R; N94K; G157M; V184Q; Q220H; L223T; S232A; E261I; Q265L; A284M; I287T; N288S; D324L; T332V; G353E; | + |
| 513/514 | S29R; N94R; G157R; Y183C; V184Q; Q220H; L223T; S232A; E261I; Q265G; A284M; I287T; N288S; D324L; T332V; G353E; | + |
| 515/516 | S29T; G157R; V184Q; Q220H; L223T; S232A; E261I; A284M; I287T; N288S; D324L; T332V; G353E; | + |
| 517/518 | S29R; G157R; V184Q; Q220H; L223T; I226L; S232A; E261I; A284M; I287T; N288S; D324L; T332V; G353E; | + |
| 519/520 | S29R; I155M; G157R; G177H; V184Q; Q220H; L223T; S232A; E261I; A284M; I287T; N288S; A311V; L323M; D324L; S328E; T332V; G353E; | + |
| 521/522 | S29T; A37H; A154Q; G157R; V184Q; Q220H; L223T; S232A; E261I; A284M; I287T; N288S; A311C; D324L; S328E; T332V; G353E; | + |
| 523/524 | S29R; N94K; G157R; Y183C; V184Q; Q220H; L223T; S232A; E261I; A284M; I287T; N288S; F294V; D324L; T332V; G353E; | + |
| 525/526 | S29R; N94K; A154F; G157M; Y183C; V184Q; Q220H; L223T; S232A; E261I; A284M; I287T; N288S; D324L; T332V; G353E; | + |
| 527/528 | S29R; N94R; G157L; V184Q; Q220H; L223T; S232A; E261I; Q265L; A284M; I287T; N288S; L323V; D324L; T332V; G353E; | + |
| 529/530 | S29R; N94R; G157L; V184Q; Q220H; L223T; S232A; E261I; Q265L; A284M; I287T; N288S; L308F; D324L; T332V; G353E; | + |
| 531/532 | S29R; A154M; G157R; G177H; V184Q; Q220H; L223T; S232R; E261I; A284M; I287T; N288S; A311C; D324L; S328E; T332V; G353E; | + |
| 533/534 | S29R; A154M; G157R; G177H; V184Q; Q220H; L223T; S232A; C256V; E261I; A284M; I287T; N288S; A311V; D324L; T332V; G353E; | + |
| 535/536 | S29R; A154F; G157R; V184Q; Q220H; L223T; S232A; E261I; A284M; I287T; N288S; D324L; S328A; T332V; G353E; | + |
| 537/538 | S29R; G157L; V184Q; Q220H; L223T; S232A; E261I; Q265L; A284M; I287T; N288S; D324L; T332V; G353E; | + |
| 539/540 | S29R; G157R; Y183C; V184Q; Q220H; L223T; S232A; E261I; A284M; I287T; N288S; L323V; D324L; T332V; G353E; | + |

TABLE 3H-continued

Engineered Polypeptides and Relative Enzyme Improvements Using HTP Preparations

| SEQ ID NO: (nt/aa) | Amino Acid Differences (Relative to SEQ ID NO: 96) | Increased Activity[1] (compound (1j) assay[2]) |
|---|---|---|
| 541/542 | S4R; S29R; K74R; G157R; C163T; V184Q; Q220H; L223T; S232A; E261I; A284M; I287T; N288S; D324L; T332V; G353E; | + |
| 543/544 | S29R; A154M; G157R; V184Q; Q220H; L223T; S232A; E261I; A284M; I287T; N288S; D324L; S328E; T332V; G353E; | + |
| 545/546 | S29R; A154M; I155M; G157R; V184Q; Q220H; L223T; S232A; C256V; E261I; A284M; I287T; N288S; A311V; D324L; S328E; T332V; G353E; | + |
| 547/548 | S4H; S29R; N94R; A154Y; G157L; V184Q; Q220H; L223T; S232A; E261I; A284M; I287T; N288S; L323T; D324L; T332V; G353E; | + |
| 549/550 | S29R; G157R; Y183C; V184Q; Q220H; L223T; S232A; E261I; Q265L; A284M; I287T; N288S; F294V; D324L; T332V; G353E; | + |
| 551/552 | S29R; A154F; G157R; V184Q; Q220H; L223T; S232A; E261I; A284M; I287T; N288S; A311C; D324L; T332V; G353E; | + |
| 553/554 | S29R; A37H; E124L; A154F; G157R; G177H; V184Q; Q220H; L223T; S232A; E261I; A284M; I287T; N288S; A311C; L323M; D324L; S328E; T332V; G353E; | + |
| 555/556 | S29R; A154Y; G157R; Y183C; V184Q; Q220H; L223T; S232A; E261I; Q265L; A284M; I287T; N288S; D324L; T332V; G353E; | + |
| 557/558 | S29R; N94T; G157R; V184Q; Q220H; L223T; S232A; E261I; Q265L; A284M; I287T; N288S; D324L; T332V; G353E; | + |
| 559/560 | S29R; G157R; V184Q; Q220H; L223T; S232A; E261I; A284M; I287T; N288S; L323I; D324L; T332V; G353E; | + |
| 561/562 | S29R; A154F; I155M; G157R; V184Q; Q220H; L223T; S232R; C256V; E261I; A284M; I287T; N288S; A311V; D324L; T332V; G353E; | + |
| 563/564 | S29R; A154Q; G157R; V184Q; Q220H; L223T; S232A; E261I; A284M; I287T; N288S; A311V; D324L; T332V; G353E; | + |
| 565/566 | S29R; E124N; A154Q; G157R; G177C; V184Q; Q220H; L223T; S232A; E261I; A284M; I287T; N288S; D324L; S328A; T332V; G353E; | + |
| 567/568 | S29R; A154Q; G157R; V184Q; Q220H; L223T; S232A; E261I; A284M; I287T; N288S; D324L; S328E; T332V; G353E; | + |
| 569/570 | S29R; N94T; G157R; V184Q; Q220H; L223T; S232A; E261I; Q265L; A284M; I287T; N288S; L308F; D324L; T332V; G353E; | + |
| 571/572 | S29R; G157R; V184Q; Q220H; L223T; S232A; E261I; A284M; I287T; N288S; E296W; D324L; T332V; G353E; | + |
| 573/574 | S29R; G157R; V184Q; Q220H; L223T; S232A; E261I; I270G; A284M; I287T; N288S; D324L; T332V; G353E; | + |
| 575/576 | S29R; N94K; G157R; Y183C; V184Q; Q220H; L223T; S232A; E261I; Q265G; A284M; I287T; N288S; F294A; D324L; T332V; G353E; | + |

[1]Levels of increased activity were determined relative to the activity of the reference polypeptide of SEQ ID NO: 354 and defined as follows: "+" = at least 1.3-fold but less than 2-fold increased activity; "++" = at least 2-fold but less than 3-fold increased activity; "+++" = at least 3-fold increased activity but less than 5-fold.
[2]Substrate compound (1j) activity assay: Lysate preparation, HTP assay reaction, and work-up and analysis were carried out as described in Note 3, Table 3G.

TABLE 3I

Engineered Polypeptides and Relative Enzyme Improvements Using HTP Preparations

| SEQ ID NO: (nt/aa) | Amino Acid Differences (Relative to SEQ ID NO: 96) | Increased Activity[1] (compound (1j) assay) |
|---|---|---|
| 577/578 | S29R; N94R; G157R; V184Q; Q220H; L223T; S232A; H259V; E261I; A279F; A284M; I287T; N288S; D324L; T332V; G353E; | ++ |
| 579/580 | S29R; N94K; A111R; A154Y; G157R; V184Q; Q220H; L223T; S232A; H259V; E261I; A279V; A284M; I287T; N288S; D324L; T332V; G353E; | + |
| 581/582 | S29R; S137N; G157R; V184Q; Q220H; L223T; S232A; H259V; E261I; A279V; A284M; I287T; N288S; D324L; T332V; G353E; | + |
| 583/584 | S29R; N94K; A111R; G157R; V184Q; Q220H; L223T; S232A; H259V; E261I; A279F; A284M; I287T; N288S; D324L; T332V; G353E; | + |
| 585/586 | S29R; N94R; G157R; V184Q; Q220H; L223T; S232A; H259V; E261I; A279V; A284M; I287T; N288S; D324L; T332V; G353E; | ++ |
| 587/588 | S29R; N94R; A154Y; G157R; V184Q; Q220H; L223T; S232A; H259V; E261I; A279F; A284M; I287T; N288S; E296W; D324L; T332V; G353E; | ++ |
| 589/590 | S29R; N94R; A111R; G157R; V184Q; Q220H; L223T; S232A; H259V; E261I; A279V; A284M; I287T; N288S; D324L; T332V; G353E; | ++ |
| 591/592 | S29R; N94K; G157R; V184Q; Q220H; L223T; S232A; H259V; E261I; A279F; A284M; I287T; N288S; D324L; T332V; G353E; | ++ |
| 593/594 | S29R; N94R; A111R; S137N; G157R; V184Q; Q220H; L223T; S232A; H259V; E261I; A279V; A284M; I287T; N288S; D324L; T332V; G353E; | +++ |
| 595/596 | S29R; N94K; G157R; V184Q; Q220H; L223T; S232A; H259V; E261I; A279F; A284M; I287T; N288S; E296W; D324L; T332V; G353E; | ++ |

TABLE 3I-continued

Engineered Polypeptides and Relative Enzyme Improvements Using HTP Preparations

| SEQ ID NO: (nt/aa) | Amino Acid Differences (Relative to SEQ ID NO: 96) | Increased Activity[1] (compound (1j) assay) |
|---|---|---|
| 597/598 | S29R; N94K; A111R; S137N; G157R; V184Q; Q220H; L223T; S232A; H259V; E261I; A279V; A284M; I287T; N288S; D324L; T332V; G353E; | +++ |
| 599/600 | S29R; N94K; G157R; V184Q; Q220H; L223T; S232A; H259V; E261I; A284M; I287T; N288S E296W; D324L; T332V; G353E; | + |
| 601/602 | S29R; N94K; G157R; V184Q; Q220H; L223T; S232A; H259V; E261I; A279V; A284M; I287T; N288S; D324L; T332V; G353E; | +++ |
| 603/604 | S29R; N94R; S137N; G157R; V184Q; Q220H; L223T; S232A; H259V; E261I; A279F; A284M; I287T; N288S; D324L; T332V; G353E; | + |
| 605/606 | S29R; G157R; V184Q; Q220H; L223T; S232A; H259V; E261I; A284M; I287T; N288S; E296W; D324L; T332V; G353E; | + |
| 607/608 | S29R; N94R; A111R; S137N; G157R; V184Q; Q220H; L223T; S232A; H259V; E261I; A279F; A284M; I287T; N288S; D324L; T332V; G353E; | ++ |
| 609/610 | S29R; A154Y; G157R; V184Q; Q220H; L223T; S232A; H259V; E261I; A279F; A284M; I287T; N288S; E296W; D324L; T332V; G353E; | ++ |
| 611/612 | S29R; G157R; V184Q; Q220H; L223T; S232A; H259V; E261I; A279F; A284M; I287T; N288S; E296W; D324L; T332V; G353E; | ++ |
| 613/614 | S29R; N94K; S137N; G157R; V184Q; Q220H; L223T; S232A; H259V; E261I; A279V; A284M; I287T; N288S; E296W; D324L; T332V; G353E; | +++ |
| 615/616 | S29R; N94R; G157R; V184Q; Q220H; L223T; S232A; H259V; E261I; A279F; A284M; I287T; N288S; E296W; D324L; T332V; G353E; | +++ |
| 617/618 | S29R; N94K; A111R; S137N; A154Y; G157R; V184Q; Q220H; L223T; S232A; H259V; E261I; A279V; A284M; I287T; N288S; D324L; T332V; G353E; | +++ |
| 619/620 | S29R; N94R; G157R; V184Q; Q220H; L223T; S232A; H259V; E261I; A284M; I287T; N288S; D324L; T332V; G353E; | + |
| 621/622 | S29R; N94R; G157R; V184Q; Q220H; L223T; S232A; H259V; E261I; A279V; A284M; I287T; N288S; E296W; D324L; T332V; G353E; | +++ |
| 623/624 | S29R; G157R; V184Q; Q220H; L223T; S232A; H259V; E261I; A279V; A284M; I287T; N288S; E296W; D324L; T332V; G353E; | ++ |

[1]Levels of increased activity were determined relative to the activity of the reference polypeptide of SEQ ID NO: 448 and defined as follows: "+" = at least 1.3-fold but less than 2-fold increased activity; "++" = at least 2-fold but less than 3-fold increased activity; "+++" = at least 3-fold increased activity but less than 5-fold.
[2]Substrate compound (1j) activity assay: Lysate preparation, HTP assay reaction, and work-up and analysis were carried out as described in Note 3, Table 3G.

TABLE 3J

Engineered Polypeptides and Relative Enzyme Improvements Using HTP Preparations

| SEQ ID NO: (nt/aa) | Amino Acid Differences (Relative to SEQ ID NO: 96) | Increased Activity[1] (compound (1j) assay) |
|---|---|---|
| 625/626 | S29R; N94R; A111R; S137N; G157R; G177H; V184Q; Q220H; L223T; S232A; H259V; E261I; Q265L; A279V; A284M; I287T; N288S; A311T; D324L; T332V; G353E; | + |
| 627/628 | S29R; N94K; A111R; S137N; G157R; V184Q; Q220H; L223T; S232A; H259V; E261I; Q265L; S266T; A279V; A284M; I287T; N288S; F295S; A311V; S328A; T332V; G353E; | ++ |
| 629/630 | S29R; L71V; N94K; A111R; S137N; G157R; Y183C; V184Q; Q220H; L223T; S232A; H259V; E261I; S266T; A279V; A284M; I287T; N288S; F295S; A311V; D324L; T332V; G353E; | ++ |
| 631/632 | S29R; N94K; A111R; S137N; G157R; G177H; V184Q; Q220H; L223T; S232A; H259V; E261I; A279V; A284M; I287T; N288S; A311V; D324L; T332V; G353E; | + |
| 633/634 | S29R; L71V; N94R; A111R; S137N; G157R; V184Q; Q220H; L223T; S232A; H259V; E261I; A279V; A284M; I287T; N288S; F295S; A311V; D324L; T332V; G353E; | ++ |
| 635/636 | S29R; N94T; A111R; S137N; G157R; G177H; V184Q; Q220H; L223T; S232A; H259V; E261I; A279V; A284M; I287T; N288S; F295S; A311V; D324L; S328E; T332V; G353E; | ++ |
| 637/638 | S29R; N94R; A111R; S137N; G157R; Y183C; V184Q; Q220H; L223T; S232A; H259V; E261I; A279V; A284M; I287T; N288S; A311T; D324L; S328E; T332V; G353E; | ++ |
| 639/640 | S29R; N94K; A111R; S137N; G157R; V184Q; Q220H; L223T; S232A; H259V; E261I; S266T; A279V; A284M; I287T; N288S; F295S; A311V; D324L; T332V; G353E; | + |
| 641/642 | S29R; N94R; A111R; S137N; G157L; Y183C; V184Q; Q220H; L223T; S232A; H259V; E261I; Q265L; A279V; A284M; I287T; N288S; A311V; D324L; T332V; G353E; | + |
| 643/644 | S29R; L71C; N94R; A111R; S137N; G157L; G177H; V184Q; Q220H; L223T; S232A; H259V; E261I; S266T; A279V; A284M; I287T; N288S; A311V; D324L; S328E; T332V; G353E; | +++ |

TABLE 3J-continued

Engineered Polypeptides and Relative Enzyme Improvements Using HTP Preparations

| SEQ ID NO: (nt/aa) | Amino Acid Differences (Relative to SEQ ID NO: 96) | Increased Activity[1] (compound (1j) assay) |
|---|---|---|
| 645/646 | S29R; N94K; A111R; S137N; G157R; G177H; Y183C; V184Q; Q220H; L223T; S232A; H259V; E261I; Q265L; S266T; A279V; A284M; I287T; N288S; D324L; S328E; T332V; G353E; | ++ |
| 647/648 | S29R; N94K; A111R; S137N; G157R; V184Q; Q220H; L223T; S232A; H259V; E261I; S266T; A279V; A284M; I287T; N288S; F295S; A311V; D324L; S328E; T332V; G353E; | ++ |
| 649/650 | S29R; N94K; A111R; S137N; A154Y; G157L; V184Q; Q220H; L223T; S232A; H259V; E261I; A279V; A284M; I287T; N288S; A311V; D324L; T332V; G353E; | ++ |
| 651/652 | S29R; L71V; N94K; A111R; S137N; G157L; V184Q; Q220H; L223T; S232A; H259V; E261I; A279V; A284M; I287T; N288S; F295S; A311V; D324L; T332V; G353E; | ++ |
| 653/654 | S29R; L71C; N94R; A111R; S137N; G157R; G177H; V184Q; Q220H; L223T; S232A; H259V; E261I; Q265L; A279V; A284M; I287T; N288S; F295S; A311V; D324L; S328A; T332V; G353E; | + |
| 655/656 | S29R; N94K; A111R; S137N; G157L; G177H; V184Q; Q220H; L223T; S232A; H259V; E261I; Q265L; A279V; A284M; I287T; N288S; A311V; D324L; S328E; T332V; G353E; | ++ |
| 657/658 | S29R; N94R; A111R; S137N; A154Y; G157R; V184Q; Q220H; L223T; S232A; H259V; E261I; A279V; A284M; I287T; N288S; A311V; D324L; S328A; T332V; G353E; | ++ |
| 659/660 | S29R; N94K; A111R; S137N; A154Y; G157R; G177H; V184Q; Q220H; L223T; S232A; H259V; E261I; Q265L; S266T; A279V; A284M; I287T; N288S; F295S; D324L; S328E; T332V; G353E; | ++ |
| 661/662 | S29R; L71C; N94R; A111R; S137N; G157L; G177H; V184Q; Q220H; L223T; S232A; H259V; E261I; A279V; A284M; I287T; N288S; A311V; D324L; T332V; G353E; | ++ |
| 663/664 | S29R; L71V; N94K; A111R; S137N; G157R; V184Q; Q220H; L223T; S232A; H259V; E261I; Q265L; A279V; A284M; I287T; N288S; F295S; A311V; D324L; S328E; T332V; G353E; | ++ |
| 665/666 | S29R; N94K; A111R; S137N; G157L; V184Q; Q220H; L223T; S232A; H259V; E261I; S266T; A279V; A284M; I287T; N288S; F295S; A311V; D324L; S328E; T332V; G353E; | +++ |
| 667/668 | S29R; L71V; N94K; A111R; S137N; G157L; G177H; V184Q; Q220H; L223T; S232A; H259V; E261I; S266T; A279V; A284M; I287T; N288S; A311V; D324L; S328E; T332V; G353E; | +++ |
| 669/670 | S29R; L71V; N94R; A111R; S137N; G157L; V184Q; Q220H; L223T; S232A; H259V; E261I; Q265L; A279V; A284M; I287T; N288S; D324L; T332V; G353E; | + |
| 671/672 | S29R; N94K; A111R; S137N; G157L; G177H; V184Q; Q220H; L223T; S232A; H259V; E261I; Q265L; A279V; A284M; I287T; N288S; A311V; D324L; T332V; G353E; | ++ |
| 673/674 | S29R; N94K; A111R; S137N; G157L; V184Q; Q220H; L223T; S232A; H259V; E261I; A279V; A284M; I287T; N288S; A311T; D324L; S328E; T332V; G353E; | ++ |
| 675/676 | S29R; L71V; N94K; A111R; S137N; G157R; Y183C; V184Q; Q220H; L223T; S232A; H259V; E261I; A279V; A284M; I287T; N288S; A311V; D324L; S328E; T332V; G353E; | ++ |
| 677/678 | S29R; L71C; N94K; A111R; S137N; G157L; G177H; V184Q; Q220H; L223T; S232A; H259V; E261I; Q265L; A279V; A284M; I287T; N288S; A311V; D324L; T332V; G353E; | ++ |
| 679/680 | S29R; N94K; A111R; S137N; G157R; G177H; V184Q; Q220H; L223T; S232A; H259V; E261I; A279V; A284M; I287T; N288S; A311T; D324L; S328E; T332V; G353E; | + |
| 681/682 | S29R; N94K; A111R; S137N; G157R; Y183C; V184Q; Q220H; L223T; S232A; H259V; E261I; Q265L; S266T; A279V; A284M; I287T; N288S; A311V; D324L; T332V; G353E; | ++ |
| 683/684 | S29R; N94K; A111R; S137N; G157R; V184Q; Q220H; L223T; S232A; H259V; E261I; A279V; A284M; I287T; N288S; A311T; D324L; T332V; G353E; | + |
| 685/686 | S29R; L71C; N94K; A111R; S137N; G157R; V184Q; Q220H; L223T; S232A; H259V; E261I; Q265L; A279V; A284M; I287T; N288S; A311V; D324L; T332V; G353E; | + |
| 687/688 | S29R; L71C; N94K; A111R; S137N; A154F; G157L; V184Q; Q220H; L223T; S232A; H259V; E261I; Q265L; A279V; A284M; I287T; N288S; A311V; D324L; S328E; T332V; G353E; | + |
| 689/690 | S29R; N94K; A111R; S137N; G157L; G177H; V184Q; Q220H; L223T; S232A; H259V; E261I; Q265L; A279V; A284M; I287T; N288S; A311T; D324L; T332V; G353E; | + |
| 691/692 | S29R; L71V; N94K; A111R; S137N; A154Y; G157R; V184Q; Q220H; L223T; S232A; H259V; E261I; S266T; A279V; A284M; I287T; N288S; F295S; A311V; D324L; T332V; G353E; | ++ |
| 693/694 | S29R; N94K; A111R; S137N; G157R; G177H; V184Q; Q220H; L223T; S232A; H259V; E261I; A279V; A284M; I287T; N288S; F295S; A311V; D324L; S328E; T332V; G353E; | +++ |
| 695/696 | S29R; N94R; A111R; S137N; G157L; V184Q; Q220H; L223T; S232A; H259V; E261I; A279V; A284M; I287T; N288S; F295S; A311V; D324L; T332V; G353E; | ++ |

TABLE 3J-continued

Engineered Polypeptides and Relative Enzyme Improvements Using HTP Preparations

| SEQ ID NO: (nt/aa) | Amino Acid Differences (Relative to SEQ ID NO: 96) | Increased Activity[1] (compound (1j) assay) |
|---|---|---|
| 697/698 | S29R; L71C; N94K; A111R; S137N; G157R; V184Q; Q220H; L223T; S232A; H259V; E261I; A279V; A284M; I287T; N288S; F295S; A311V; D324L; T332V; G353E; | ++ |
| 699/700 | S29R; N94K; A111R; S137N; G157R; G177H; Y183C; V184Q; Q220H; L223T; S232A; H259V; E261I; A279V; A284M; I287T; N288S; A311T; D324L; S328E; T332V; G353E; | ++ |
| 701/702 | S29R; L71V; N94R; A111R; S137N; G157L; G177H; V184Q; Q220H; L223T; S232A; H259V; E261I; S266T; A279V; A284M; I287T; N288S; A311T; D324L; S328A; T332V; G353E; | + |
| 703/704 | S29R; L71C; N94K; A111R; S137N; G157R; Y183C; V184Q; Q220H; L223T; S232A; H259V; E261I; S266T; A279V; A284M; I287T; N288S; F295S; A311V; D324L; T332V; G353E; | ++ |
| 705/706 | S29R; L71V; N94R; A111R; S137N; G157L; V184Q; Q220H; L223T; S232A; H259V; E261I; A279V; A284M; I287T; N288S; A311V; D324L; S328E; T332V; G353E; | +++ |
| 707/708 | S29R; N94K; A111R; S137N; G157L; G177H; V184Q; Q220H; L223T; S232A; H259V; E261I; A279V; A284M; I287T; N288S; F295S; A311T; D324L; S328A; T332V; G353E; | + |
| 709/710 | S29R; L71V; N94K; A111R; S137N; G157R; V184Q; Q220H; L223T; S232A; H259V; E261I; Q265L; S266T; A279V; A284M; I287T; N288S; A311V; D324L; S328E; T332V; G353E; | ++ |
| 711/712 | S29R; L71V; N94K; A111R; S137N; A154Y; G157R; G177H; V184Q; Q220H; L223T; S232A; H259V; E261I; A279V; A284M; I287T; N288S; A311V; D324L; T332V; G353E; | ++ |
| 713/714 | S29R; L71V; N94T; A111R; S137N; G157R; G177H; V184Q; Q220H; L223T; S232A; H259V; E261I; A279V; A284M; I287T; N288S; F295S; A311V; D324L; S328E; T332V; G353E; | ++ |
| 715/716 | S29R; N94R; A111R; S137N; G157L; Y183C; V184Q; Q220H; L223T; S232A; H259V; E261I; Q265L; A279V; A284M; I287T; N288S; A311V; D324L; S328A; T332V; G353E; | + |
| 717/718 | S29R; N94K; A111R; S137N; G157R; V184Q; Q220H; L223T; S232A; H259V; E261I; A279V; A284M; I287T; N288S; D324L; T332V; G353E; | + |
| 719/720 | S29R; N94K; A111R; S137N; G157R; V184Q; Q220H; L223T; S232A; H259V; E261I; N277I; A279V; A284M; I287T; N288S; D324L; T332V; G353E; | + |
| 721/722 | S29R; N94K; A111R; S137N; G157R; V184Q; Q220H; L223T; S232A; H259V; E261I; A273W; A279V; A284M; I287T; N288S; D324L; I326V; T332V; G353E; | + |
| 723/724 | S29R; N94K; A111R; S137N; G157R; V184Q; Q220H; L223T; S232A; H259V; E261I; N277A; A279V; A284M; I287T; N288S; D324L; T332V; G353E; | + |
| 725/726 | S29R; N94K; A111R; S137N; G157R; V184Q; Q220H; L223T; S232A; H259V; E261I; A273W; A279V; A284M; I287T; N288S; D324L; T332V; G353E; | + |
| 727/728 | S29R; N94K; A111R; S137N; G157R; V184Q; Q220H; L223T; S232A; H259V; E261I; A279V; I283V; A284M; I287T; N288S; D324L; T332V; G353E; | + |
| 729/730 | S29R; N94K; A111R; S137N; G157R; V184Q; Q220H; L223T; S232A; H259V; E261I; A279L; A284M; I287T; N288S; D324L; T332V; G353E; | + |
| 731/732 | S29R; N94K; A111R; S137N; G157R; V184Q; Q220H; L223T; S232A; H259W; E261I; A279V; A284M; I287T; N288S; D324L; T332V; G353E; | + |
| 733/734 | S29R; N94K; A111R; S137N; G157R; V184Q; Q220H; L223T; S232A; H259V; E261I; V274M; A279V; A284M; I287T; N288S; D324L; T332V; G353E; | + |
| 735/736 | S29R; N94K; A111R; S137N; A154F; G157R; V184Q; Q220H; L223T; S232A; H259V; E261I; A279V; A284M; I287T; N288S; D324L; T332V; G353E; | + |
| 737/738 | S29R; N94K; A111R; S137N; N153V; G157R; V184Q; Q220H; L223T; S232A; H259V; E261I; A279V; A284M; I287T; N288S; D324L; T332V; G353E; | ++ |
| 739/740 | S29R; N94K; A111R; S137N; N153Y; G157R; V184Q; Q220H; L223T; S232A; H259V; E261I; A279V; A284M; I287T; N288S; D324L; T332V; G353E; | +++ |
| 741/742 | S29R; N94K; A111R; S137N; T141W; G157R; V184Q; Q220H; L223T; S232A; H259V; E261I; A279V; A284M; I287T; N288S; D324L; T332V; G353E; | + |
| 743/744 | S29R; N94K; A111R; S137N; R143W; G157R; V184Q; Q220H; L223T; S232A; H259V; E261I; A279V; A284M; I287T; N288S; D324L; T332V; G353E; | + |
| 745/746 | S29R; V82P; N94K; A111R; S137N; G157R; V184Q; Q220H; L223T; S232A; H259V; E261I; A279V; A284M; I287T; N288S; D324L; T332V; G353E; | + |
| 747/748 | S29R; N94K; S137N; G157R; V184Q; Q220H; L223T; S232A; H259V; E261I; A279V; A284M; I287T; N288S; E296V; D324L; T332V; G353E; | + |
| 749/750 | S29R; N94K; S137N; G157R; V184Q; Q220H; L223T; S232A; H259V; E261I; A279V; A284M; I287T; N288S; E296N; D324L; T332V; G353E; | + |

[1]Levels of increased activity were determined relative to the activity of the reference polypeptide of SEQ ID NO: 598 and defined as follows: "+" = at least 1.3-fold but less than 2-fold increased activity; "++" = at least 2-fold but less than 3-fold increased activity; "+++" = at least 3-fold increased activity but less than 5-fold.
[2]Substrate compound (1j) activity assay: Lysate preparation, HTP assay reaction, and work-up and analysis were carried out as described in Note 3, Table 3G.

From an analysis of the exemplary polypeptides, improvements in enzyme properties are associated with residue differences as compared to SEQ ID NO:2 at residue positions X4, X5, X14, X20, X29, X37, X67, X71, X74, X82, X94, X97, X100, X111, X124, X136, X137, X141, X143, X149, X153, X154, X156, X157, X158, X160, X163, X177, X178, X183, X184, X185, X186, X197, X198, X201, X220, X223, X226, X232, X243, X246, X256, X258, X259, X260, X261, X265, X266, X270, X273, X274, X277, X279, X280, X283, X284, X287, X288, X292, X293, X294, X295, X296, X297, X308, X311, X323, X324, X326, X328, X332, X353, and X356. The specific residue differences at each of these positions that are associated with the improved properties include: X4H/L/R; X5T; X14P; X20T; X29R/T; X37H; X67A/D; X71C/V; X74R; X82P; X94K/R/T; X97P; X100W; X111M/Q/R/S; X124L/N; X136G; X137N; X141W; X143W; X149L; X153V/Y; X154F/M/Q/Y; X156G/I/Q/S/T/V; X157D/H/L/M/N/R; X158K; X160N; X163T; X177C/H; X178E; X183C; X184K/Q/R; X185V; X186K/R; X197I/P; X198A/E/H/P/S; X201L; X220D/H; X223T; X226L; X232A/R; X243G; X246W; X256V; X258D; X259E/H/I/L/M/S/T/V/W; X260G; X261A/G/I/K/R/S/T; X265G/L/Y; X266T; X270G; X273W; X274M; X277A/I; X279F/L/V/Y; X280L; X283V; X284K/L/M/Y; X287S/T; X288G/S; X292C/G/I/P/S/T/V/Y; X293H/I/K/L/N/Q/T/V; X294A/IN; X295R/S; X296L/N/V/W; X297A; X308F; X311C/T/V; X323C/I/M/T/V; X324L/T; X326V; X328A/G/E; X332V; X353E; and X356R.

The specific enzyme properties associated with the residues differences as compared to SEQ ID NO:4 at the residue positions above include, among others, enzyme activity, stereoselectivity, polypeptide expression. Improvements in enzyme activity are associated with residue differences at residue positions X111, X136, X156, X197, X198, X201, X259, X280, X292, and X293. Improvements in selectivity for unactivated ketone substrates (as measured by increased activity in converting cyclohexanone and L-norvaline to compound (3c)) are associated with residue differences at residue positions: X197; X198; X201; X292; and includes the specific amino acid residue differences: X197I/P; X198A/E/H/P/S; X201L; X292C/G/I/P/S/T/V/Y; and X293H/I/K/L/N/Q/T/V. Improvements in selectivity for unactivated amine substrates (as measured by increased activity in pyruvate and butylamine to compound (3b)) are associated with residue differences at residue positions: X111, X136, X156, X197P, X259, and X280; and includes the specific amino acid residue differences: X111M/Q/S, X136G, X156G/I/Q/S/T/V, X197P, X259E/H/I/L/M/S/T, and X280L. Improvements in selectivity for the combination of unactivated ketone and unactivated amine substrates (as measured by increased activity in converting cyclohexanone and butylamine to compound (3d)) are associated with residue differences at residue positions: X198, X259, and X280; and includes the specific amino acid residue differences: X198E/H, X259M/H, and X280L. Accordingly, the residue differences at the foregoing residue positions can be used individually or in various combinations to produce engineered imine reductase polypeptides having the desired improved properties, including, among others, enzyme activity, stereoselectivity, and substrate tolerance. Other residue differences affecting polypeptide expression can be used to increase expression of the engineered imine reductase.

Improvements in enzyme activity and stability are associated with residue differences at residue positions X4, X5, X14, X20, X29, X37, X67, X71, X74, X82, X94, X97, X100, X124, X137, X141, X143, X149, X153, X154, X157, X158, X160, X163, X177, X178, X183, X184, X185, X186, X220, Z223, X226, X232, X243, X246, X256, X258, X260, X261, X265, X266, X270, X273, X274, X277, X279, X283, X284, X287, X288, X294, X295, X296, X297, X308, X311, X323, X324, X326, X328, X332, X353, and X356. Improvements in activity and stability for the conversion of the ketone substrates compounds (1i) or compound (1j), and the amine substrate, butylamine (2b), to the amine products of compounds (3n) and (3o), respectively, are associated with the specific amino acid residue differences X4H/L/R, X5T, X14P, X20T, X29R/T, X37H, X67A/D, X71C/V, X74R, X82P, X94K/R/T, X97P, X100W, X111R, X124L/N, X137N, X141W, X143W, X149L, X153V/Y, X154F/M/Q/Y, X157D/H/L/M/N/R, X158K, X160N, X163T, X177C/H, X178E, X183C, X184K/Q/R, X185V, X186K/R, X220D/H, X223T, X226L, X232A/R, X243G, X246W, X256V, X258D, X259V/W, X260G, X261A/G/I/K/R/S/T, X265G/L/Y, X266T, X270G, X273W, X274M, X277A/I, X279F/L/V/Y, X283V, X284K/L/M/Y, X287S/T, X288G/S, X294A/I/V, X295R/S, X296L/N/V/W, X297A, X308F, X311C/T/V, X323C/I/M/T/V, X324L/T, X326V, X328A/G/E, X332V, X353E, and X356R.

Additionally, as noted in the Background, the crystal structure of the opine dehydrogenase CENDH has been determined (see Britton et al., "Crystal structure and active site location of N-(1-D-carboxyethyl)-L-norvaline dehydrogenase," Nat. Struct. Biol. 5(7): 593-601 (1998)). Accordingly, this correlation of the various amino acid differences and functional activity disclosed herein along with the known three-dimensional structure of the wild-type enzyme CENDH can provide the ordinary artisan with sufficient information to rationally engineer further amino acid residue changes to the polypeptides provided herein (and to homologous opine dehydrogenase enzymes including OpDH, BADH, CEOS, and TauDH), and retain or improve on the imine reductase activity properties. In some embodiments, it is contemplated that such improvements can include engineering the naturally occurring opine dehydrogenase polypeptides or the engineered polypeptides of the present disclosure to have imine reductase activity with a range of substrates and provide a range of products as described in Scheme 1.

In some embodiments, the present disclosure provides an engineered polypeptide having imine reductase activity, comprising an amino acid sequence having at least 80% sequence identity to a naturally occurring opine dehydrogenase amino acid sequence selected from the group consisting of SEQ ID NO: 2, 102, 104, 106, 108, and 110, and further comprising one or more residue differences as compared to the amino sequence of selected naturally occurring opine dehydrogenase. In some embodiments of the engineered polypeptide derived from an opine dehydrogenase, the imine reductase activity is the activity of Scheme 1, optionally, a reaction as disclosed in Table 2, and optionally, the reaction of converting compound (1b) and compound (2b) to product compound (3d).

In light of the guidance provided herein, it is further contemplated that any of the exemplary engineered polypeptide sequences of even-numbered sequence identifiers SEQ ID NO: 4-100 and 112-750, or exemplary naturally occurring opine dehydrogenase polypeptides of SEQ ID NO: 2, 102, 104, 106, 108, and 110, can be used as the starting amino acid sequence for synthesizing other engineered imine reductase polypeptides, for example by subsequent rounds of evolution by adding new combinations of various amino acid differences from other polypeptides in Tables 3A-3J, and other residue positions described herein. Further improvements may be generated by including amino acid differences at residue positions that had been maintained as unchanged throughout earlier rounds of evolution. Accordingly, in some embodiments, the engineered polypeptide having imine reductase activity comprises an amino acid sequence having at least 80%, 85%, 86%, 87%, 88%, 89%, 90%, 91%, 92%, 93%, 94%, 95%, 96%, 97%, 98%, 99% or more sequence identity to reference sequence SEQ ID NO:2 and one or more residue differences as compared to SEQ ID NO:2 at residue positions selected from: X111, X136, X156, X197, X198, X201, X259, X280, X292, and X293.

In some embodiments, the engineered polypeptide having imine reductase activity comprises an amino acid sequence having at least 80%, 85%, 86%, 87%, 88%, 89%, 90%, 91%, 92%, 93%, 94%, 95%, 96%, 97%, 98%, 99% or more sequence identity to reference sequence SEQ ID NO:2 and a residue difference as compared to the sequence of SEQ ID NO: 2 at residue position X198, wherein optionally the residue difference at position X198 is selected from X198A, X198E, X198H, X198P, and X198S. In some embodiments, the engineered polypeptide having a residue difference at position X198 comprises an amino acid sequence that is selected from X198E, and X198H.

In some embodiments, the engineered polypeptide having imine reductase activity with improved properties as compared to SEQ ID NO:2, comprises an amino acid sequence having at least 80%, 85%, 86%, 87%, 88%, 89%, 90%, 91%, 92%, 93%, 94%, 95%, 96%, 97%, 98%, 99% or more identity to a reference sequence selected from SEQ ID NO: 4, 6, 8, 10, 12, 14, 16, 18, 20, 22, 24, 26, 28, 30, 32, 34, 36, 38, 40, 42, 44, 46, 48, 50, 52, 54, 56, 58, 60, 62, 64, 66, 68, 70, 72, 74, 76, 78, 80, 82, 84, 86, 88, 90, 92, 94, 96, 98, and 100, and one or more residue differences as compared to SEQ ID NO:2 at residue positions selected from: X111, X136, X156, X197, X198, X201, X259, X280, X292, and X293. In some embodiments, the reference sequence is selected from SEQ ID NO: 6, 50, 58, 60, 62, 64, 72, 74, 76, 78, 88, 90, 92, 94, 96, 98 and 100. In some embodiments, the reference sequence is SEQ ID NO: 2. In some embodiments, the reference sequence is SEQ ID NO: 6. In some embodiments, the reference sequence is SEQ ID NO: 88. In some embodiments, the reference sequence is SEQ ID NO: 90. In some embodiments, the reference sequence is SEQ ID NO: 92. In some embodiments, the reference sequence is SEQ ID NO: 94. In some embodiments, the reference sequence is SEQ ID NO: 96. In some embodiments, the reference sequence is SEQ ID NO: 98. In some embodiments, the reference sequence is SEQ ID NO: 100.

In some embodiments, the residue differences at residue positions X111, X136, X156, X197, X198, X201, X259, X280, X292, and X293 are selected from X111M, X111Q, X111S, X136G, X156G, X156I, X156Q, X156S, X156T, X156V, X197I, X197P, X198A, X198E, X198H, X198P, X198S, X201L, X259E, X259H, X259I, X259L, X259M, X259S, X259T, X280L, X292C, X292G, X292I, X292P, X292S, X292T, X292V, X292Y, X293H, X293I, X293K, X293L, X293N, X293Q, X293T, and X293V.

Accordingly, in some embodiments, the engineered imine reductase polypeptides displaying one or more of the improved properties described herein can comprise an amino acid sequence having the amino acid sequence identity to a reference sequence as described above, and one or more residue differences as compared to SEQ ID NO:2 selected from: X111M, X111Q, X111S, X136G, X156G, X156I, X156Q, X156S, X156T, X156V, X197I, X197P, X198A, X198E, X198H, X198P, X198S, X201L, X259E, X259H, X259I, X259L, X259M, X259S, X259T, X280L, X292C, X292G, X292I, X292P, X292S, X292T, X292V, X292Y, X293H, X293I, X293K, X293L, X293N, X293Q, X293T, and X293V.

In some embodiments, the engineered imine reductase has an amino acid sequence comprising at least one or more residue differences as compared to SEQ ID NO:2 selected from: X198E, X198H, X259M, X259H, and X280L.

In some embodiments, the engineered imine reductase polypeptide comprises an amino acid sequence having at least a combination of residues differences as compared to SEQ ID NO:2 selected from: (a) X111M, X156T, X198H, X259M, X280L, X292V, and X293H; (b) X156T, X197P, X198H, X259H, X280L, X292P, and X293H; (c) X111M, X198H, X156S, X197I, X198H, X201L, X259H, X280L, X292V, and X293H; (d) X197I, X198E, X259M, and X280L; (e) X156T, X197I, X198E, X201L, X259H, X280L, X292V, and X293H; (f) X111M, X136G, X198H, X259M, X280L, X292S, and X293H; and (g) X156V, X197P, X198E, X201L, X259M, X280L, and X292T.

As will be appreciated by the skilled artisan, in some embodiments, one or a combination of residue differences above that is selected can be kept constant in the engineered imine reductases as a core sequence, and additional residue differences at other residue positions incorporated into the core sequence to generate additional engineered imine reductase polypeptides with improved properties. Accordingly, it is to be understood for any engineered imine reductase containing one or a subset of the residue differences above, the present disclosure contemplates other engineered imine reductases that comprise the one or subset of the residue differences, and additionally one or more residue differences at the other residue positions disclosed herein. By way of example and not limitation, an engineered imine reductase comprising a residue difference at residue position X280, can further incorporate one or more residue differences at the other residue positions, e.g., X111, X136, X156, X197, X198, X201, X259, X292, and X293. Another example is an engineered imine reductase comprising a residue difference at residue position X156, which can further comprise one or more residue differences at the other residue positions, e.g., X111, X136, X197, X198, X201, X259, X280, X292, and X293.

Indeed, the engineered imine reductase polypeptide of SEQ ID NO: 96 which comprises the combination of residue differences as compared to SEQ ID NO:2: X156T, X197I, X198E, X201L, X259H, X280L, X292V, and X293H, was further evolved to generate additional engineered imine reductase polypeptides with improved activity and stability. These further improved engineered imine reductase polypeptides comprise one or more residue differences as compared to the sequence of SEQ ID NO: 2 at residue positions selected from X4, X5, X14, X20, X29, X37, X67, X71, X74, X82, X94, X97, X100, X111, X124, X137, X141, X143, X149, X153, X154, X157, X158, X160, X163, X177, X178, X183, X184, X185, X186, X220, X223, X226, X232, X243, X246, X256, X258, X259, X260, X261, X265, X266, X270, X273, X274, X277, X279, X283, X284, X287, X288, X294, X295, X296, X297, X308, X311, X323, X324, X326, X328, X332, X353, and X356. The specific amino acid residue differences at these positions associated with improved activity or stability are selected from X4H/L/R, X5T, X14P, X20T, X29R/T, X37H, X67A/D, X71C/V, X74R, X82P, X94K/R/T, X97P, X100W, X111R, X124L/N, X137N, X141W, X143W, X149L, X153V/Y, X154F/M/Q/Y, X157D/H/L/M/N/R, X158K, X160N, X163T, X177C/H, X178E, X183C, X184K/Q/R, X185V, X186K/R, X220D/H, X223T, X226L, X232A/R, X243G, X246W, X256V, X258D, X259V/W, X260G, X261A/G/I/K/R/S/T, X265G/L/Y, X266T, X270G, X273W, X274M, X277A/I, X279F/L/V/Y, X283V, X284K/L/M/Y, X287S/T, X288G/S, X294A/I/V, X295R/S, X296L/N/V/W, X297A, X308F, X311C/T/V, X323C/I/M/T/V, X324L/T, X326V, X328A/G/E, X332V, X353E, and X356R.

Accordingly, in some embodiments the engineered polypeptide having imine reductase activity comprises an amino acid sequence having at least 80% sequence identity to SEQ ID NO: 2 (or any of the exemplary engineered polypeptides of SEQ ID NO: 4-100), one or more residue differences as compared to the sequence of SEQ ID NO: 2 at residue positions selected from X111, X136, X156, X197, X198, X201, X259, X280, X292, and X293 (as described above), and further comprises one or more residue differences as compared to the sequence of SEQ ID NO: 2 at residue positions selected from X4, X5, X14, X20, X29, X37, X67, X71, X74, X82, X94, X97, X100, X111, X124, X137, X141, X143, X149, X153, X154, X157, X158, X160, X163, X177, X178, X183, X184, X185, X186, X220, X223, X226, X232, X243, X246, X256, X258, X259, X260, X261, X265, X266, X270, X273, X274, X277, X279, X283, X284, X287, X288, X294, X295, X296, X297, X308, X311, X323, X324, X326, X328, X332, X353, and X356. In some embodiments, these further residue differences are selected from X4H/L/R, X5T, X14P, X20T, X29R/T, X37H, X67A/D, X71C/V, X74R, X82P, X94K/R/T, X97P, X100W, X111R, X124L/N, X137N, X141W, X143W, X149L, X153V/Y, X154F/M/Q/Y, X157D/H/L/M/N/R, X158K, X160N, X163T, X177C/H, X178E, X183C, X184K/Q/R, X185V, X186K/R, X220D/H, X223T, X226L, X232A/R, X243G, X246W, X256V, X258D, X259V/W, X260G, X261A/G/I/K/R/S/T, X265G/L/Y, X266T, X270G, X273W, X274M, X277A/I, X279F/L/V/Y, X283V, X284K/L/M/Y, X287S/T, X288G/S, X294A/I/V, X295R/S, X296L/N/V/W, X297A, X308F, X311C/T/V, X323C/I/M/T/V, X324L/T, X326V, X328A/G/E, X332V, X353E, X356R.

In some embodiments, the engineered polypeptide having imine reductase activity can comprise an amino acid sequence having at least 80% sequence identity to SEQ ID NO: 2, one or more residue differences as compared to the sequence of SEQ ID NO: 2 at residue positions selected from X111, X136, X156, X197, X198, X201, X259, X280, X292, and X293 (as described above), and further comprise at least a combination of residue differences selected from: (a) X29R, X184R, X223T, X261S, X284M, and X287T; (b) X29R, X157R, X184Q, X220H, X223T, X232A, X261I, X284M, X287T, X288S, X324L, X332V, and X353E; (c) X29R, X157R, X184Q, X220H, X223T, X232A, X259V, X261I, X284M, X287T, X288S, X324L, X332V, and X353E; (d) X29R, X94K, X111R, X137N, X157R, X184Q, X220H, X223T, X232A, X259V, X261I, X279V, X284M, X287T, X288S, X324L, X332V, and X353E; and (e) X29R, X94K, X111R, X137N, X157R, X184Q, X220H, X223T, X232A, X259V, X261I, X266T, X279V, X284M, X287T, X288S, X295S, X311V, X324L, X328E, X332V, and X353E.

In some embodiments, the engineered polypeptide having imine reductase activity comprises an amino acid sequence having at least 80% sequence identity to SEQ ID NO: 2 and the combination of residue differences X156T, X197I, X198E, X201L, X259H, X280L, X292V, and X293H, and further comprising one or more residue differences selected from X29R/T, X94K/R/T, X111R, X137N, X157D/H/L/M/N/R, X184K/Q/R, X220D/H, X223T, X232A/R, X259V/W, X261A/G/I/K/R/S/T, X266T, X279F/L/V/Y, X284K/L/M/Y, X287S/T, X288G/S, X295S, X311V, X324L/T, X328E, X332V, and X353E. In some embodiment, the sequence comprises the combination of residue differences X156T, X197I, X198E, X201L, X259H, X280L, X292V, and X293H, and further comprises at least a combination of residue differences selected from: (a) X29R, X184R, X223T, X261S, X284M, and X287T; (b) X29R, X157R, X184Q, X220H, X223T, X232A, X261I, X284M, X287T, X288S, X324L, X332V, and X353E; (c) X29R, X157R, X184Q, X220H, X223T, X232A, X259V, X261I, X284M, X287T, X288S, X324L, X332V, and X353E; (d) X29R, X94K, X111R, X137N, X157R, X184Q, X220H, X223T, X232A, X259V, X261I, X279V, X284M, X287T, X288S, X324L, X332V, and X353E; and (e) X29R, X94K, X111R, X137N, X157R, X184Q, X220H, X223T, X232A, X259V, X261I, X266T, X279V, X284M, X287T, X288S, X295S, X311V, X324L, X328E, X332V, and X353E.

Generally, the engineered polypeptides having imine reductase activity of the present disclosure are capable of converting a compound of formula (I) and an compound of formula (II) to an amine product compound of formula (III) (as illustrated by Scheme 1) with improved activity and/or improved stereoselectivity relative to the *Arthrobacter* Sp. Strain C1 wild-type opine dehydrogenase reference polypeptide of SEQ ID NO: 2, or relative to a reference polypeptide having imine reductase activity selected from the engineered polypeptides of even-numbered sequence identifiers SEQ ID NO: 4-100 and 112-750. In some embodiments, the improved activity and/or improved stereoselectivity is with respect to the conversion of a specific combination of a compound of formula (I) and a compound of formula (II) shown in Table 2 to the corresponding amine product compound of formula (III) shown in Table 2.

Accordingly, in some embodiments, the engineered polypeptides having imine reductase activity of the present disclosure which have an amino acid sequence having at least 80%, 85%, 86%, 87%, 88%, 89%, 90%, 91%, 92%, 93%, 94%, 95%, 96%, 97%, 98%, 99% or more identity to a reference sequence selected from even-numbered sequence identifiers SEQ ID NO: 4-100 and 112-750, and one or more residue differences as compared to SEQ ID NO:2 at residue positions selected from: X4, X5, X14, X20, X29, X37, X67, X71, X74, X82, X94, X97, X100, X111, X124, X136, X137, X141, X143, X149, X153, X154, X156, X157, X158, X160, X163, X177, X178, X183, X184, X185, X186, X197, X198, X201, X220, X223, X226, X232, X243, X246, X256, X258, X259, X260, X261, X265, X266, X270, X273, X274, X277, X279, X280, X283, X284, X287, X288, X292, X293, X294, X295, X296, X297, X308, X311, X323, X324, X326, X328, X332, X353, and X356, are capable of one or more of the following conversion reactions, under suitable reaction conditions, with improved activity and/or improved stereoselectivity relative to a reference polypeptide of even-numbered sequence identifiers SEQ ID NO: 4-100 and 112-750:

(a) conversion of substrate compounds (1a) and (2a) to product compound (3a);
(b) conversion of substrate compounds (1a) and (2b) to product compound (3b);
(c) conversion of substrate compounds (1b) and (2a) to product compound (3c);
(d) conversion of substrate compounds (1b) and (2b) to product compound (3d);
(e) conversion of substrate compounds (1b) and (2c) to product compound (3e);
(f) conversion of substrate compounds (1b) and (2d) to product compound (3f);
(g) conversion of substrate compounds (1c) and (2a) to product compound (3g);
(h) conversion of substrate compounds (1d) and (2a) to product compound (3h);
(i) conversion of substrate compounds (1e) and (2b) to product compound (3i);
(j) conversion of substrate compounds (1f) and (2b) to product compound (3j);
(k) conversion of substrate compounds (1g) and (2e) to product compound (3k);

(l) conversion of substrate compounds (1b) and (20 to product compound (3l);

(m) conversion of substrate compounds (1h) and (2a) to product compound (3m);

(n) conversion of substrate compounds (1i) and (2b) to product compound (3n); and (o) conversion of substrate compounds (1j) and (2b) to product compound (3o).

In some embodiments, the engineered polypeptide having imine reductase activity and capable of catalyzing one or more of the above conversion reactions (a)-(o), under suitable reaction conditions, with improved activity and/or stereoselectivity comprises an amino acid sequence having at least 80%, 85%, 86%, 87%, 88%, 89%, 90%, 91%, 92%, 93%, 94%, 95%, 96%, 97%, 98%, or 99% identity to one of even-numbered sequence identifiers SEQ ID NO: 2-100 and 112-750, and the amino acid residue differences as compared to SEQ ID NO:2 present in any one of even-numbered sequence identifiers SEQ ID NO: 4-100 and 112-750, as provided in Tables 3A-3J. In some embodiments, the engineered polypeptide having imine reductase activity and capable of catalyzing one or more of the above conversion reactions (a)-(o), under suitable reaction conditions, with improved activity and/or stereoselectivity has an amino acid sequence comprising a sequence selected from the even-numbered sequence identifiers SEQ ID NO: 4-100 and 112-750.

In some embodiments, the engineered imine reductase polypeptide is capable of converting the ketone substrate of compound (1a) and the amine substrate of compound (2b) to the amine product compound (3b) with at least 1.2 fold, 1.5 fold, 2 fold, 3 fold, 4 fold, 5 fold, 10 fold or more activity relative to the activity of the reference polypeptide of SEQ ID NO: 2. In some embodiments, the engineered imine reductase polypeptide capable of converting the ketone substrate of compound (1a) and the amine substrate of compound (2b) to the amine product compound (3b) with at least 1.2 fold, 1.5 fold, 2 fold, 3 fold, 4 fold, 5 fold, 10 fold, 20 fold 30 fold, 40 fold, 50 fold or more activity relative to the activity of the reference polypeptide of SEQ ID NO:2 comprises an amino acid sequence having one or more residue differences selected from: X111M/Q/S, X136G, X156G/I/Q/S/T/V, X259E/H/I/L/M/S/T, and X280L. In some embodiments, the engineered imine reductase polypeptide capable of converting the ketone substrate of compound (1a) and the amine substrate of compound (2b) to the amine product compound (3b) with at least 1.2 fold the activity relative to SEQ ID NO:2 and comprises an amino acid sequence selected from: SEQ ID NO: 8, 12, 14, 18, 20, 22, 24, 26, 28, 30, 32, 36, 38, 42, 44, 46, 50, 78, and 84.

In some embodiments, the engineered imine reductase polypeptide is capable of converting the ketone substrate of compound (1b) and the amine substrate of compound (2a) to the amine product compound (3c) with at least 1.2 fold, 1.5 fold, 2 fold, 3 fold, 4 fold, 5 fold, 10 fold or more activity relative to the activity of the reference polypeptide of SEQ ID NO: 2. In some embodiments, the engineered imine reductase polypeptide capable of converting the ketone substrate of compound (1b) and the amine substrate of compound (2a) to the amine product compound (3c) with at least 1.2 fold, 1.5 fold, 2 fold, 3 fold, 4 fold, 5 fold, 10 fold, 20 fold 30 fold, 40 fold, 50 fold or more activity relative to the activity of the reference polypeptide of SEQ ID NO:2 comprises an amino acid sequence having one or more residue differences selected from: X197I/P, X198A/E/H/P/S, X201L, X292C/G/I/P/S/T/V/Y, and X293H/I/K/L/N/Q/T/V. In some embodiments, the engineered imine reductase polypeptide is capable of converting the ketone substrate of compound (1b) and an amine substrate of compound (2a) to a secondary amine product compound (3c) with at least 1.2 fold the activity relative to SEQ ID NO:2 and comprises an amino acid sequence selected from: SEQ ID NO: 4, 6, 16, 40, 48, 52, 54, 56, 58, 60, 62, 64, 66, 68, 70, 72, 74, 76, 78, 80, 82, 84, and 86.

As noted above, the wild-type opine dehydrogenase from *Arthrobacter* Sp. Strain C1 (CENDH) of SEQ ID NO: 2 from which the engineered polypeptides of the present disclosure were derived has no detectable activity in converting a ketone substrate of compound (1b) and an amine substrate of compound (2b) to a secondary amine product compound (3d). In some embodiments, however, the engineered polypeptides having imine reductase activity are capable of converting a ketone substrate of compound (1b) and an amine substrate of compound (2b) to a secondary amine product compound (3d). Further, in some embodiments, the engineered imine reductase polypeptides are capable of converting the ketone substrate of compound (1b) and the amine substrate of compound (2b) to the amine product compound (3d) with at least 1.2 fold, 1.5 fold, 2 fold, 3 fold, 4 fold, 5 fold, 10 fold or more activity relative to the activity of a reference polypeptide of SEQ ID NO: 90, 92, or 94, each of which is an engineered polypeptide having at least detectable activity in this conversion. In some embodiments, the engineered imine reductase polypeptide capable of converting the ketone substrate of compound (1b) and the amine substrate of compound (2b) to the amine product compound (3d) with at least 1.2 fold, 1.5 fold, 2 fold, 3 fold, 4 fold, 5 fold, 10 fold, 20 fold 30 fold, 40 fold, 50 fold or more activity relative to the activity of the reference polypeptide of SEQ ID NO: 90, 92, or 94 comprises an amino acid sequence having a combination of residue differences selected from: (a) X111M, X156T, X198H, X259M, X280L, X292V, and X293H; (b) X156T, X197P, X198H, X259H, X280L, X292P, and X293H; (c) X111M, X136G, X156S, X197I, X198H, X201L, X259H, X280L, X292V, and X293H; (d) X197I, X198E, X259M, and X280L; (e) X156T, X197I, X198E, X201L, X259H, X280L, X292V, and X293H; (f) X111M, X136G, X198H, X259M, X280L, X292S, and X293H; and (g) X156V, X197P, X198E, X201L, X259M, X280L, and X292T. In some embodiments, the engineered imine reductase polypeptide is capable of converting the ketone substrate of compound (1b) and the amine substrate of compound (2b) to the amine product compound (3d) comprises an amino acid sequence selected from: SEQ ID NO: 88, 90, 92, 94, 96, 98, and 100.

In addition to the positions of residue differences specified above, any of the engineered imine reductase polypeptides disclosed herein can further comprise other residue differences relative to SEQ ID NO:2 at other residue positions, i.e., residue positions other than X111, X136, X156, X197, X198, X201, X259, X280, X292, and X293. Residue differences at these other residue positions can provide for additional variations in the amino acid sequence without adversely affecting the ability of the polypeptide to catalyze one or more of the above conversion reactions (a)-(o) from Table 2. Accordingly, in some embodiments, in addition to the amino acid residue differences present in any one of the engineered imine reductase polypeptides selected from SEQ ID NO: 4, 6, 8, 10, 12, 14, 16, 18, 20, 22, 24, 26, 28, 30, 32, 34, 36, 38, 40, 42, 44, 46, 48, 50, 52, 54, 56, 58, 60, 62, 64, 66, 68, 70, 72, 74, 76, 78, 80, 82, 84, 86, 88, 90, 92, 94, 96, 98, and 100, the sequence can further comprise 1-2, 1-3, 1-4, 1-5, 1-6, 1-7, 1-8, 1-9, 1-10, 1-11, 1-12, 1-14, 1-15, 1-16, 1-18, 1-20, 1-22, 1-24, 1-26, 1-30, 1-35, 1-40, 1-45, or 1-50 residue differences at other amino acid residue positions as compared to the SEQ ID NO:2. In some embodiments, the number of amino acid residue differences as compared to the reference sequence can be 1, 2, 3, 4, 5, 6, 7, 8, 9, 10, 11, 12, 13, 14, 15, 16, 17, 18, 19, 20, 21, 22, 23, 24, 25, 30, 30, 35, 40, 45 or 50 residue positions. In some embodiments, the number of amino acid residue differences as compared to the reference sequence can be 1, 2, 3, 4, 5, 6, 7, 8, 9, 10, 11, 12, 13, 14, 15, 16, 18, 20, 21, 22, 23, 24, or 25 residue positions. The residue difference at these other positions can be conservative changes or non-conservative changes. In some embodiments, the residue differences can comprise conservative substitutions and non-conservative substitutions as compared to the naturally occurring imine reductase polypeptide of SEQ ID NO: 2.

In some embodiments, the present disclosure also provides engineered polypeptides that comprise a fragment of any of the engineered imine reductase polypeptides described herein that retains the functional activity and/or improved property of that engineered imine reductase. Accordingly, in some embodiments, the present disclosure provides a polypeptide fragment capable of catalyzing one or more of the above conversion reactions (a)-(o) of Table 2, under suitable reaction conditions, wherein the fragment comprises at least about 80%, 90%, 95%, 96%, 97%, 98%, or 99% of a full-length amino acid sequence of an engineered imine reductase polypeptide of the present disclosure, such as an exemplary engineered imine reductase polypeptide selected from even-numbered sequence identifiers SEQ ID NO: 4-100 and 112-750.

In some embodiments, the engineered imine reductase polypeptide can have an amino acid sequence comprising a deletion of any one of the engineered imine reductase polypeptides described herein, such as the exemplary engineered polypeptides of even-numbered sequence identifiers SEQ ID NO: 4-100 and 112-750. Thus, for each and every embodiment of the engineered imine reductase polypeptides of the disclosure, the amino acid sequence can comprise deletions of one or more amino acids, 2 or more amino acids, 3 or more amino acids, 4 or more amino acids, 5 or more amino acids, 6 or more amino acids, 8 or more amino acids, 10 or more amino acids, 15 or more amino acids, or 20 or more amino acids, up to 10% of the total number of amino acids, up to 10% of the total number of amino acids, up to 20% of the total number of amino acids, or up to 30% of the total number of amino acids of the imine reductase polypeptides, where the associated functional activity and/or improved properties of the engineered imine reductase described herein is maintained. In some embodiments, the deletions can comprise 1-2, 1-3, 1-4, 1-5, 1-6, 1-7, 1-8, 1-9, 1-10, 1-15, 1-20, 1-21, 1-22, 1-23, 1-24, 1-25, 1-30, 1-35, 1-40, 1-45, or 1-50 amino acid residues. In some embodiments, the number of deletions can be 1, 2, 3, 4, 5, 6, 7, 8, 9, 10, 11, 12, 13, 14, 15, 16, 17, 18, 19, 20, 21, 22, 23, 24, 25, 30, 30, 35, 40, 45, or 50 amino acid residues. In some embodiments, the deletions can comprise deletions of 1, 2, 3, 4, 5, 6, 7, 8, 9, 10, 11, 12, 13, 14, 15, 16, 18, 20, 21, 22, 23, 24, or 25 amino acid residues.

In some embodiments, the engineered imine reductase polypeptide herein can have an amino acid sequence comprising an insertion as compared to any one of the engineered imine reductase polypeptides described herein, such as the exemplary engineered polypeptides of even-numbered sequence identifiers SEQ ID NO: 4-100 and 112-750. Thus, for each and every embodiment of the imine reductase polypeptides of the disclosure, the insertions can comprise one or more amino acids, 2 or more amino acids, 3 or more amino acids, 4 or more amino acids, 5 or more amino acids, 6 or more amino acids, 8 or more amino acids, 10 or more amino acids, 15 or more amino acids, 20 or more amino acids, 30 or more amino acids, 40 or more amino acids, or 50 or more amino acids, where the associated functional activity and/or improved properties of the engineered imine reductase described herein is maintained. The insertions can be to amino or carboxy terminus, or internal portions of the imine reductase polypeptide.

In some embodiments, the engineered imine reductase polypeptide herein can have an amino acid sequence comprising a sequence selected from even-numbered sequence identifiers SEQ ID NO: 4-100 and 112-750, and optionally one or several (e.g., up to 3, 4, 5, or up to 10) amino acid residue deletions, insertions and/or substitutions. In some embodiments, the amino acid sequence has optionally 1-2, 1-3, 1-4, 1-5, 1-6, 1-7, 1-8, 1-9, 1-10, 1-15, 1-20, 1-21, 1-22, 1-23, 1-24, 1-25, 1-30, 1-35, 1-40, 1-45, or 1-50 amino acid residue deletions, insertions and/or substitutions. In some embodiments, the number of amino acid sequence has optionally 1, 2, 3, 4, 5, 6, 7, 8, 9, 10, 11, 12, 13, 14, 15, 16, 17, 18, 19, 20, 21, 22, 23, 24, 25, 30, 30, 35, 40, 45, or 50 amino acid residue deletions, insertions and/or substitutions. In some embodiments, the amino acid sequence has optionally 1, 2, 3, 4, 5, 6, 7, 8, 9, 10, 11, 12, 13, 14, 15, 16, 18, 20, 21, 22, 23, 24, or 25 amino acid residue deletions, insertions and/or substitutions. In some embodiments, the substitutions can be conservative or non-conservative substitutions.

In the above embodiments, the suitable reaction conditions for the engineered polypeptides can be those described in Tables 3A-3J. Accordingly, in some embodiments, the suitable reaction conditions are HTP assay conditions, which can comprise: 20 mM loading each of ketone substrate and amine substrate compounds; 5 mM NADH; 20-100 µL clear lysate from E. coli expressing engineered polypeptide of interest; 100 mM potassium phosphate buffer, pH 8.5 or pH 10; and a reaction temperature at about 25° C. (room temperature) for a reaction time of about 12 h-24 h. In some embodiments, the suitable reaction conditions are those described for shake flask powder (SFP) assays, which can comprise: 50 mM loading each of ketone substrate and amine substrate compounds; 4.5 mM (3 g/L) NADH; 5-50 g/L SFP of engineered polypeptide of interest; 100 mM sodium formate; 1 g/L formate dehydrogenase (FDH-101; commercially available from Codexis, Inc. Redwood City, Calif., USA); 100 mM potassium phosphate buffer, pH 8.5 or pH 10; and a reaction temperature at about 30° C. for a reaction time of about 12 h-24 h. Guidance for use of these foregoing HTP and SFP reaction conditions and the imine reductase polypeptides are given in, among others, Tables 3A-3J, and the Examples.

In some embodiments, the polypeptides of the disclosure can be in the form of fusion polypeptides in which the engineered polypeptides are fused to other polypeptides, such as, by way of example and not limitation, antibody tags (e.g., myc epitope), purification sequences (e.g., His tags for binding to metals), and cell localization signals (e.g., secretion signals). Thus, the engineered polypeptides described herein can be used with or without fusions to other polypeptides.

It is to be understood that the polypeptides described herein are not restricted to the genetically encoded amino acids. In addition to the genetically encoded amino acids, the polypeptides described herein may be comprised, either in whole or in part, of naturally-occurring and/or synthetic non-encoded amino acids. Certain commonly encountered non-encoded amino acids of which the polypeptides described herein may be comprised include, but are not limited to: the D-stereomers of the genetically-encoded amino acids; 2,3-diaminopropionic acid (Dpr); α-aminoisobutyric acid (Aib); ε-aminohexanoic acid (Aha); δ-aminovaleric acid (Ava); N-methylglycine or sarcosine (MeGly or Sar); ornithine (Orn); citrulline (Cit); t-butylalanine (Bua); t-butylglycine (Bug); N-methylisoleucine (MeIle); phenylglycine (Phg); cyclohexylalanine (Cha); norleucine (Nle); naphthylalanine (Nal); 2-chlorophenylalanine (Ocf); 3-chlorophenylalanine (Mcf); 4-chlorophenylalanine (Pcf); 2-fluorophenylalanine (Off); 3-fluorophenylalanine (Mff); 4-fluorophenylalanine (Pff); 2-bromophenylalanine (Obf); 3-bromophenylalanine (Mbf); 4-bromophenylalanine (Pbf); 2-methylphenylalanine (Omf); 3-methylphenylalanine (Mmf); 4-methylphenylalanine (Pmf); 2-nitrophenylalanine (Onf); 3-nitrophenylalanine (Mnf); 4-nitrophenylalanine (Pnf); 2-cyanophenylalanine (Ocf); 3-cyanophenylalanine (Mcf); 4-cyanophenylalanine (Pcf); 2-trifluoromethylphenylalanine (Otf); 3-trifluoromethylphenylalanine (Mtf); 4-trifluoromethylphenylalanine (Ptf); 4-aminophenylalanine (Paf); 4-iodophenylalanine (Pif); 4-aminomethylphenylalanine (Pamf); 2,4-dichlorophenylalanine (Opef); 3,4-dichlorophenylalanine (Mpcf); 2,4-difluorophenylalanine (Opff); 3,4-difluorophenylalanine (Mpff); pyrid-2-ylalanine (2pAla); pyrid-3-ylalanine (3pAla); pyrid-4-ylalanine (4pAla); naphth-1-ylalanine (1nAla); naphth-2-ylalanine (2nAla); thiazolylalanine (taAla); benzothienylalanine (bAla); thienylalanine (tAla); furylalanine (fAla); homophenylalanine (hPhe); homotyrosine (hTyr); homotryptophan (hTrp); pentafluorophenylalanine (5ff); styrylkalanine (sAla); authrylalanine (aAla); 3,3-diphenylalanine (Dfa); 3-amino-5-phenypentanoic acid (Afp); penicillamine (Pen); 1,2,3,4-tetrahydroisoquinoline-3-carboxylic acid (Tic); β-2-thienylalanine (Thi); methionine sulfoxide (Mso); N(w)-nitroarginine (nArg); homolysine (hLys); phosphonomethylphenylalanine (pmPhe); phosphoserine (pSer); phosphothreonine (pThr); homoaspartic acid (hAsp); homoglutanic acid (hGlu); 1-aminocyclopent-(2 or 3)-ene-4 carboxylic acid; pipecolic acid (PA), azetidine-3-carboxylic acid (ACA); 1-aminocyclopentane-3-carboxylic acid; allylglycine (aOly); propargylglycine (pgGly); homoalanine (hAla); norvaline (nVal); homoleucine (hLeu), homovaline (hVal); homoisoleucine (hIle); homoarginine (hArg); N-acetyl lysine (AcLys); 2,4-diaminobutyric acid (Dbu); 2,3-diaminobutyric acid (Dab); N-methylvaline (MeVal); homocysteine (hCys); homoserine (hSer); hydroxyproline (Hyp) and homoproline (hPro). Additional non-encoded amino acids of which the polypeptides described herein may be comprised will be apparent to those of skill in the art (see, e.g., the various amino acids provided in Fasman, 1989, CRC Practical Handbook of Biochemistry and Molecular Biology, CRC Press, Boca Raton, Fla., at pp. 3-70 and the references cited therein, all of which are incorporated by reference). These amino acids may be in either the L- or D-configuration.

Those of skill in the art will recognize that amino acids or residues bearing side chain protecting groups may also comprise the polypeptides described herein. Non-limiting examples of such protected amino acids, which in this case belong to the aromatic category, include (protecting groups listed in parentheses), but are not limited to: Arg(tos), Cys (methylbenzyl), Cys (nitropyridinesulfenyl), Glu(δ-benzylester), Gln(xanthyl), Asn(N-δ-xanthyl), His(bom), His(benzyl), His(tos), Lys(fmoc), Lys(tos), Ser(O-benzyl), Thr (O-benzyl) and Tyr(O-benzyl).

Non-encoding amino acids that are conformationally constrained of which the polypeptides described herein may be composed include, but are not limited to, N-methyl amino acids (L-configuration); 1-aminocyclopent-(2 or 3)-ene-4-carboxylic acid; pipecolic acid; azetidine-3-carboxylic acid; homoproline (hPro); and 1-aminocyclopentane-3-carboxylic acid.

In some embodiments, the engineered polypeptides can be in various forms, for example, such as an isolated preparation, as a substantially purified enzyme, whole cells transformed with gene(s) encoding the enzyme, and/or as cell extracts and/or lysates of such cells. The enzymes can be lyophilized, spray-dried, precipitated or be in the form of a crude paste, as further discussed below.

In some embodiments, the engineered polypeptides can be provided on a solid support, such as a membrane, resin, solid carrier, or other solid phase material. A solid support can be composed of organic polymers such as polystyrene, polyethylene, polypropylene, polyfluoroethylene, polyethyleneoxy, and polyacrylamide, as well as co-polymers and grafts thereof. A solid support can also be inorganic, such as glass, silica, controlled pore glass (CPG), reverse phase silica or metal, such as gold or platinum. The configuration of a solid support can be in the form of beads, spheres, particles, granules, a gel, a membrane or a surface. Surfaces can be planar, substantially planar, or non-planar. Solid supports can be porous or non-porous, and can have swelling or non-swelling characteristics. A solid support can be configured in the form of a well, depression, or other container, vessel, feature, or location.

In some embodiments, the engineered polypeptides having imine reductase activity of the present disclosure can be immobilized on a solid support such that they retain their improved activity, stereoselectivity, and/or other improved properties relative to the reference polypeptide of SEQ ID NO: 2. In such embodiments, the immobilized polypeptides can facilitate the biocatalytic conversion of the ketone and amine substrate compounds of formula (I) and formula (II) to the amine product compound of formula (III), (e.g., as in conversion reactions (a)-(o) of Table 2), and after the reaction is complete are easily retained (e.g., by retaining beads on which polypeptide is immobilized) and then reused or recycled in subsequent reactions. Such immobilized enzyme processes allow for further efficiency and cost reduction. Accordingly, it is further contemplated that any of the methods of using the imine reductase polypeptides of the present disclosure can be carried out using the same imine reductase polypeptides bound or immobilized on a solid support.

Methods of enzyme immobilization are well-known in the art. The engineered polypeptides can be bound non-covalently or covalently. Various methods for conjugation and immobilization of enzymes to solid supports (e.g., resins, membranes, beads, glass, etc.) are well known in the art and described in e.g.: Yi et al., "Covalent immobilization of co-transaminase from *Vibrio fluvialis* JS17 on chitosan beads," *Process Biochemistry* 42(5): 895-898 (May 2007); Martin et al., "Characterization of free and immobilized (S)-aminotransferase for acetophenone production," *Applied Microbiology and Biotechnology* 76(4): 843-851 (September 2007); Koszelewski et al., "Immobilization of co-transaminases by encapsulation in a sol-gel/celite matrix," *Journal of Molecular Catalysis B: Enzymatic,* 63: 39-44 (April 2010); Truppo et al., "Development of an Improved Immobilized CAL-B for the Enzymatic Resolution of a Key Intermediate to Odanacatib," *Organic Process Research & Development,* published online: dx.doi.org/10.1021/op200157c; Hermanson, G. T., Bioconjugate Techniques, Second Edition, Academic Press (2008); Mateo et al., "Epoxy sepabeads: a novel epoxy support for stabilization of industrial enzymes via very intense multipoint covalent attachment," *Biotechnology Progress* 18(3): 629-34 (2002); and Bioconjugation Protocols: Strategies and Methods, In Methods in Molecular Biology, C. M. Niemeyer ed., Humana Press (2004); the disclosures of each which are incorporated by reference herein. Solid supports useful for immobilizing the engineered imine reductases of the present disclosure include but are not limited to beads or resins comprising polymethacrylate with epoxide functional groups, polymethacrylate with amino epoxide functional groups, styrene/DVB copolymer or polymethacrylate with octadecyl functional groups. Exemplary solid supports useful for immobilizing the engineered imine reductase polypeptides of the present disclosure include, but are not limited to, chitosan beads, Eupergit C, and SEPABEADs (Mitsubishi), including the following different types of SEPABEAD: EC-EP, EC-HFA/S, EXA252, EXE119 and EXE120.

In some embodiments, the polypeptides described herein can be provided in the form of kits. The enzymes in the kits may be present individually or as a plurality of enzymes. The kits can further include reagents for carrying out the enzymatic reactions, substrates for assessing the activity of enzymes, as well as reagents for detecting the products. The kits can also include reagent dispensers and instructions for use of the kits.

In some embodiments, the kits of the present disclosure include arrays comprising a plurality of different imine reductase polypeptides at different addressable position, wherein the different polypeptides are different variants of a reference sequence each having at least one different improved enzyme property. In some embodiments, a plurality of polypeptides immobilized on solid supports can be configured on an array at various locations, addressable for robotic delivery of reagents, or by detection methods and/or instruments. The array can be used to test a variety of substrate compounds for conversion by the polypeptides. Such arrays comprising a plurality of engineered polypeptides and methods of their use are described in, e.g., WO2009/008908A2.

6.4 Polynucleotides Encoding Engineered Imine Reductases, Expression Vectors and Host Cells In another aspect, the present disclosure provides polynucleotides encoding the engineered imine reductase polypeptides described herein. The polynucleotides may be operatively linked to one or more heterologous regulatory sequences that control gene expression to create a recombinant polynucleotide capable of expressing the polypeptide. Expression constructs containing a heterologous polynucleotide encoding the engineered imine reductase can be introduced into appropriate host cells to express the corresponding imine reductase polypeptide.

As will be apparent to the skilled artisan, availability of a protein sequence and the knowledge of the codons corresponding to the various amino acids provide a description of all the polynucleotides capable of encoding the subject polypeptides. The degeneracy of the genetic code, where the same amino acids are encoded by alternative or synonymous codons, allows an extremely large number of nucleic acids to be made, all of which encode the improved imine reductase enzymes. Thus, having knowledge of a particular amino acid sequence, those skilled in the art could make any number of different nucleic acids by simply modifying the sequence of one or more codons in a way which does not change the amino acid sequence of the protein. In this regard, the present disclosure specifically contemplates each and every possible variation of polynucleotides that could be made encoding the polypeptides described herein by selecting combinations based on the possible codon choices, and all such variations are to be considered specifically disclosed for any polypeptide described herein, including the amino acid sequences presented in Tables 3A-3J and disclosed in the sequence listing incorporated by reference herein as even-numbered sequence identifiers SEQ ID NO: 4-100 and 112-750.

In various embodiments, the codons are preferably selected to fit the host cell in which the protein is being produced. For example, preferred codons used in bacteria are used to express the gene in bacteria; preferred codons used in yeast are used for expression in yeast; and preferred codons used in mammals are used for expression in mammalian cells. In some embodiments, all codons need not be replaced to optimize the codon usage of the imine reductases since the natural sequence will comprise preferred codons and because use of preferred codons may not be required for all amino acid residues. Consequently, codon optimized polynucleotides encoding the imine reductase enzymes may contain preferred codons at about 40%, 50%, 60%, 70%, 80%, or greater than 90% of codon positions of the full length coding region.

In some embodiments, the polynucleotide comprises a codon optimized nucleotide sequence encoding the naturally occurring imine reductase polypeptide of SEQ ID NO:2. In some embodiments, the polynucleotide has a nucleic acid sequence comprising at least 90%, 91%, 92%, 93%, 94%, 95%, 96%, 97%, 98%, 99% or more identity to the codon optimized nucleic acid sequence of SEQ ID NO: 1. The codon optimized sequence of SEQ ID NO:1 enhances expression of the encoded, naturally occurring imine reductase, providing preparations of enzyme capable of converting in vitro over 80% of compound (2) to compound (1) under mini-DSP Assay conditions, and converting over 45% of compound (2) to compound (1) under DSP Assay conditions.

In some embodiments, the polynucleotides are capable of hybridizing under highly stringent conditions to a reference sequence of SEQ ID NO: 1, or a complement thereof, and encodes a polypeptide having imine reductase activity.

In some embodiments, as described above, the polynucleotide encodes an engineered polypeptide having imine reductase activity with improved properties as compared to SEQ ID NO: 2, where the polypeptide comprises an amino acid sequence having at least 80%, 85%, 86%, 87%, 88%, 89%, 90%, 91%, 92%, 93%, 94%, 95%, 96%, 97%, 98%, 99% or more identity to a reference sequence selected from even-numbered sequence identifiers SEQ ID NO: 4-100 and 112-750, and one or more residue differences as compared to SEQ ID NO:2 at residue positions selected from: X4, X5, X14, X20, X29, X37, X67, X71, X74, X82, X94, X97, X100, X111, X124, X136, X137, X141, X143, X149, X153, X154, X156, X157, X158, X160, X163, X177, X178, X183, X184, X185, X186, X197, X198, X201, X220, X223, X226, X232, X243, X246, X256, X258, X259, X260, X261, X265, X266, X270, X273, X274, X277, X279, X280, X283, X284, X287, X288, X292, X293, X294, X295, X296, X297, X308, X311, X323, X324, X326, X328, X332, X353, and X356. In some embodiments, the residue differences at these residue positions are selected from: X4H/L/R; X5T; X14P; X20T; X29R/T; X37H; X67A/D; X71C/V; X74R; X82P; X94K/R/T; X97P; X100W; X111M/Q/R/S; X124L/N; X136G; X137N; X141W; X143W; X149L; X153V/Y; X154F/M/Q/Y; X156G/I/Q/S/T/V; X157D/H/L/M/N/R; X158K; X160N; X163T; X177C/H; X178E; X183C; X184K/Q/R; X185V; X186K/R; X197I/P; X198A/E/H/P/S; X201L; X220D/H; X223T; X226L; X232A/R; X243G; X246W; X256V; X258D; X259E/H/I/L/M/S/T/V/W; X260G; X261A/G/I/K/R/S/T; X265G/L/Y; X266T; X270G; X273W; X274M; X277A/I; X279F/L/V/Y; X280L; X283V; X284K/L/M/Y; X287S/T; X288G/S; X292C/G/I/P/S/T/V/Y; X293H/I/K/L/N/Q/T/V; X294A/IN; X295R/S; X296L/N/V/W; X297A; X308F; X311C/T/V; X323C/I/M/T/V; X324L/T; X326V; X328A/G/E; X332V; X353E; and X356R. In some embodiments, the reference sequence is selected from SEQ ID NO: 6, 50, 58, 60, 62, 64, 72, 74, 76, 78, 88, 90, 92, 94, 96, 98 and 100. In some embodiments, the reference sequence is SEQ ID NO: 2. In some embodiments, the reference sequence is SEQ ID NO: 6. In some embodiments, the reference sequence is SEQ ID NO: 88. In some embodiments, the reference sequence is SEQ ID NO: 90. In some embodiments, the reference sequence is SEQ ID NO: 92. In some embodiments, the reference sequence is SEQ ID NO: 94. In some embodiments, the reference sequence is SEQ ID NO: 96. In some embodiments, the reference sequence is SEQ ID NO: 98. In some embodiments, the reference sequence is SEQ ID NO: 100.

In some embodiments, the polynucleotide encodes a imine reductase polypeptide capable of converting substrate compounds (1b) and (2b) to the product compound (3d) with improved properties as compared to SEQ ID NO:2, wherein the polypeptide comprises an amino acid sequence having at least 80%, 85%, 86%, 87%, 88%, 89%, 90%, 91%, 92%, 93%, 94%, 95%, 96%, 97%, 98%, 99% or more sequence identity to reference sequence SEQ ID NO:2 and one or more residue differences as compared to SEQ ID NO: 2 at residue positions selected from: X111, X136, X156, X197, X198, X201, X259, X280, X292, and X293.

In some embodiments, the polynucleotide encodes a imine reductase polypeptide capable of converting substrate compounds (1b) and (2b) to the product compound (3d) with improved properties as compared to SEQ ID NO:2, wherein the polypeptide comprises an amino acid sequence having at least 80%, 85%, 86%, 87%, 88%, 89%, 90%, 91%, 92%, 93%, 94%, 95%, 96%, 97%, 98%, 99% or more sequence identity to reference sequence SEQ ID NO:2, and at least a combination of residue differences as compared to SEQ ID NO: 2 selected from: (a) X111M, X156T, X198H, X259M, X280L, X292V, and X293H; (b) X156T, X197P, X198H, X259H, X280L, X292P, and X293H; (c) X111M, X136G, X156S, X197I, X198H, X201L, X259H, X280L, X292V, and X293H; (d) X197I, X198E, X259M, and X280L; (e) X156T, X197I, X198E, X201L, X259H, X280L, X292V, and X293H; (f) X111M, X136G, X198H, X259M, X280L, X292S, and X293H; and (g) X156V, X197P, X198E, X201L, X259M, X280L, and X292T.

In some embodiments, the polynucleotide encodes an engineered imine reductase polypeptide capable of converting substrate compounds (1b) and (2b) to the product compound (3d) with improved enzyme properties as compared to the reference polypeptide of SEQ ID NO: 2, wherein the polypeptide comprises an amino acid sequence having at least 80%, 85%, 86%, 87%, 88%, 89%, 90%, 91%, 92%, 93%, 94%, 95%, 96%, 97%, 98%, or 99% identity to a reference polypeptide selected from any one of even-numbered sequence identifiers SEQ ID NO: 4-100 and 112-750, with the proviso that the amino acid sequence comprises any one of the set of residue differences as compared to SEQ ID NO: 2 contained in any one of the polypeptide sequences of even-numbered sequence identifiers SEQ ID NO: 4-100 and 112-750, as listed in Tables 3A-3J.

In some embodiments, the polynucleotide encoding the engineered imine reductase comprises an polynucleotide sequence selected from the odd-numbered sequence identifiers SEQ ID NO: 3-99 and 111-749.

In some embodiments, the polynucleotides are capable of hybridizing under highly stringent conditions to a reference polynucleotide sequence selected from the odd-numbered sequence identifiers SEQ ID NO: 3-99 and 111-749, or a complement thereof, and encodes a polypeptide having imine reductase activity with one or more of the improved properties described herein. In some embodiments, the polynucleotide capable of hybridizing under highly stringent conditions encodes a imine reductase polypeptide that has an amino acid sequence that comprises one or more residue differences as compared to SEQ ID NO: 2 at residue positions selected from: X4, X5, X14, X20, X29, X37, X67, X71, X74, X82, X94, X97, X100, X111, X124, X136, X137, X141, X143, X149, X153, X154, X156, X157, X158, X160, X163, X177, X178, X183, X184, X185, X186, X197, X198, X201, X220, X223, X226, X232, X243, X246, X256, X258, X259, X260, X261, X265, X266, X270, X273, X274, X277, X279, X280, X283, X284, X287, X288, X292, X293, X294, X295, X296, X297, X308, X311, X323, X324, X326, X328, X332, X353, and X356. In some embodiments, the specific residue differences at these residue positions are selected from: X4H/L/R; X5T; X14P; X20T; X29R/T; X37H; X67A/D; X71C/V; X74R; X82P; X94K/R/T; X97P; X100W; X111M/Q/R/S; X124L/N; X136G; X137N; X141W; X143W; X149L; X153V/Y; X154F/M/Q/Y; X156G/I/Q/S/T/V; X157D/H/L/M/N/R; X158K; X160N; X163T; 177C/H; X178E; X183C; X184K/Q/R; X185V; X186K/R; X197I/P; X198A/E/H/P/S; X201L; X220D/H; X223T; X226L; X232A/R; X243G; X246W; X256V; X258D; X259E/H/I/L/M/S/T/V/W; X260G; X261A/G/I/K/R/S/T; X265G/L/Y; X266T; X270G; X273W; X274M; X277A/I; X279F/L/V/Y; X280L; X283V; X284K/L/M/Y; X287S/T; X288G/S; X292C/G/I/P/S/T/V/Y; X293H/I/K/L/N/Q/T/V; X294A/IN; X295R/S; X296L/N/V/W; X297A; X308F; X311C/T/V; X323C/I/M/T/V; X324L/T; X326V; X328A/G/E; X332V; X353E; and X356R.

In some embodiments, the polynucleotides encode the polypeptides described herein but have about 80% or more sequence identity, about 80%, 85%, 86%, 87%, 88%, 89%, 90%, 91%, 92%, 93%, 94%, 95%, 96%, 97%, 98%, or 99% or more sequence identity at the nucleotide level to a reference polynucleotide encoding the engineered imine reductase. In some embodiments, the reference polynucleotide sequence is selected from the odd-numbered sequence identifiers SEQ ID NO: 3-99 and 111-749.

An isolated polynucleotide encoding an improved imine reductase polypeptide may be manipulated in a variety of ways to provide for expression of the polypeptide. In some embodiments, the polynucleotides encoding the polypeptides can be provided as expression vectors where one or more control sequences is present to regulate the expression of the polynucleotides and/or polypeptides. Manipulation of the isolated polynucleotide prior to its insertion into a vector may be desirable or necessary depending on the expression vector. The techniques for modifying polynucleotides and nucleic acid sequences utilizing recombinant DNA methods are well known in the art. Guidance is provided in Sambrook et al., 2001, Molecular Cloning: A Laboratory Manual, 3$^{rd}$ Ed., Cold Spring Harbor Laboratory Press; and Current Protocols in Molecular Biology, Ausubel. F. ed., Greene Pub. Associates, 1998, updates to 2006.

In some embodiments, the control sequences include among others, promoters, leader sequence, polyadenylation sequence, propeptide sequence, signal peptide sequence, and transcription terminator. Suitable promoters can be selected based on the host cells used. For bacterial host cells, suitable promoters for directing transcription of the nucleic acid constructs of the present disclosure, include the promoters obtained from the *E. coli* lac operon, *Streptomyces coelicolor* agarase gene (dagA), *Bacillus subtilis* levansucrase gene (sacB), *Bacillus licheniformis* alpha-amylase gene (amyL), *Bacillus stearothermophilus* maltogenic amylase gene (amyM), *Bacillus amyloliquefaciens* alpha-amylase gene (amyQ), *Bacillus licheniformis* penicillinase gene (penP), *Bacillus subtilis* xylA and xylB genes, and prokaryotic beta-lactamase gene (VIIIa-Kamaroff et al., 1978, Proc. Natl. Acad. Sci. USA 75: 3727-3731), as well as the tac promoter (DeBoer et al., 1983, Proc. Natl. Acad. Sci. USA 80: 21-25).

Exemplary promoters for filamentous fungal host cells, include promoters obtained from the genes for *Aspergillus oryzae* TAKA amylase, *Rhizomucor miehei* aspartic proteinase, *Aspergillus niger* neutral alpha-amylase, *Aspergillus niger* acid stable alpha-amylase, *Aspergillus niger* or *Aspergillus awamori* glucoamylase (glaA), *Rhizomucor miehei* lipase, *Aspergillus oryzae* alkaline protease, *Aspergillus oryzae* triose phosphate isomerase, *Aspergillus nidulans* acetamidase, and *Fusarium oxysporum* trypsin-like protease (WO 96/00787), as well as the NA2-tpi promoter (a hybrid of the promoters from the genes for *Aspergillus niger* neutral alpha-amylase and *Aspergillus oryzae* triose phosphate isomerase), and mutant, truncated, and hybrid promoters thereof. Exemplary yeast cell promoters can be from the genes can be from the genes for *Saccharomyces cerevisiae* enolase (ENO-1), *Saccharomyces cerevisiae* galactokinase (GAL1), *Saccharomyces cerevisiae* alcohol dehydrogenase/glyceraldehyde-3-phosphate dehydrogenase (ADH2/GAP), and *Saccharomyces cerevisiae* 3-phosphoglycerate kinase. Other useful promoters for yeast host cells are described by Romanos et al., 1992, Yeast 8:423-488.

The control sequence may also be a suitable transcription terminator sequence, a sequence recognized by a host cell to terminate transcription. The terminator sequence is operably linked to the 3' terminus of the nucleic acid sequence encoding the polypeptide. Any terminator which is functional in the host cell of choice may be used in the present invention. For example, exemplary transcription terminators for filamentous fungal host cells can be obtained from the genes for *Aspergillus oryzae* TAKA amylase, *Aspergillus niger* glucoamylase, *Aspergillus nidulans* anthranilate synthase, *Aspergillus niger* alpha-glucosidase, and *Fusarium oxysporum* trypsin-like protease. Exemplary terminators for yeast host cells can be obtained from the genes for *Saccharomyces cerevisiae* enolase, *Saccharomyces cerevisiae* cytochrome C (CYC1), and *Saccharomyces cerevisiae* glyceraldehyde-3-phosphate dehydrogenase. Other useful terminators for yeast host cells are described by Romanos et al., 1992, supra.

The control sequence may also be a suitable leader sequence, a nontranslated region of an mRNA that is important for translation by the host cell. The leader sequence is operably linked to the 5' terminus of the nucleic acid sequence encoding the polypeptide. Any leader sequence that is functional in the host cell of choice may be used. Exemplary leaders for filamentous fungal host cells are obtained from the genes for *Aspergillus oryzae* TAKA amylase and *Aspergillus nidulans* triose phosphate isomerase. Suitable leaders for yeast host cells are obtained from the genes for *Saccharomyces cerevisiae* enolase (ENO-1), *Saccharomyces cerevisiae* 3-phosphoglycerate kinase, *Saccharomyces cerevisiae* alpha-factor, and *Saccharomyces cerevisiae* alcohol dehydrogenase/glyceraldehyde-3-phosphate dehydrogenase (ADH2/GAP).

The control sequence may also be a polyadenylation sequence, a sequence operably linked to the 3' terminus of the nucleic acid sequence and which, when transcribed, is recognized by the host cell as a signal to add polyadenosine residues to transcribed mRNA. Any polyadenylation sequence which is functional in the host cell of choice may be used in the present invention. Exemplary polyadenylation sequences for filamentous fungal host cells can be from the genes for *Aspergillus oryzae* TAKA amylase, *Aspergillus niger* glucoamylase, *Aspergillus nidulans* anthranilate synthase, *Fusarium oxysporum* trypsin-like protease, and *Aspergillus niger* alpha-glucosidase. Useful polyadenylation sequences for yeast host cells are described by Guo and Sherman, 1995, Mol Cell Bio 15:5983-5990.

The control sequence may also be a signal peptide coding region that codes for an amino acid sequence linked to the amino terminus of a polypeptide and directs the encoded polypeptide into the cell's secretory pathway. The 5' end of the coding sequence of the nucleic acid sequence may inherently contain a signal peptide coding region naturally linked in translation reading frame with the segment of the coding region that encodes the secreted polypeptide. Alternatively, the 5' end of the coding sequence may contain a signal peptide coding region that is foreign to the coding sequence. Any signal peptide coding region which directs the expressed polypeptide into the secretory pathway of a host cell of choice may be used in the present invention. Effective signal peptide coding regions for bacterial host cells are the signal peptide coding regions obtained from the genes for *Bacillus* NC1B 11837 maltogenic amylase, *Bacillus stearothermophilus* alpha-amylase, *Bacillus licheniformis* subtilisin, *Bacillus licheniformis* beta-lactamase, *Bacillus stearothermophilus* neutral proteases (nprT, nprS, nprM), and *Bacillus subtilis* prsA. Further signal peptides are described by Simonen and Palva, 1993, Microbiol Rev 57: 109-137. Effective signal peptide coding regions for filamentous fungal host cells can be the signal peptide coding regions obtained from the genes for *Aspergillus oryzae* TAKA amylase, *Aspergillus niger* neutral amylase, *Aspergillus niger* glucoamylase, *Rhizomucor miehei* aspartic proteinase, *Humicola insolens* cellulase, and *Humicola lanuginosa* lipase. Useful signal peptides for yeast host cells can be from the genes for *Saccharomyces cerevisiae* alpha-factor and *Saccharomyces cerevisiae* invertase. Other useful signal peptide coding regions are described by Romanos et al., 1992, supra.

The control sequence may also be a propeptide coding region that codes for an amino acid sequence positioned at the amino terminus of a polypeptide. The resultant polypeptide is known as a proenzyme or propolypeptide (or a zymogen in some cases). A propolypeptide can be converted to a mature active polypeptide by catalytic or autocatalytic cleavage of the propeptide from the propolypeptide. The propeptide coding region may be obtained from the genes for *Bacillus subtilis* alkaline protease (aprE), *Bacillus subtilis* neutral protease (nprT), *Saccharomyces cerevisiae* alpha-factor, *Rhizomucor miehei* aspartic proteinase, and *Myceliophthora thermophila* lactase (WO 95/33836). Where both signal peptide and propeptide regions are present at the amino terminus of a polypeptide, the propeptide region is positioned next to the amino terminus of a polypeptide and the signal peptide region is positioned next to the amino terminus of the propeptide region.

It may also be desirable to add regulatory sequences, which allow the regulation of the expression of the polypeptide relative to the growth of the host cell. Examples of regulatory systems are those which cause the expression of the gene to be turned on or off in response to a chemical or physical stimulus, including the presence of a regulatory compound. In prokaryotic host cells, suitable regulatory sequences include the lac, tac, and hp operator systems. In yeast host cells, suitable regulatory systems include, as examples, the ADH2 system or GAL1 system. In filamentous fungi, suitable regulatory sequences include the TAKA alpha-amylase promoter, *Aspergillus niger* glucoamylase promoter, and *Aspergillus oryzae* glucoamylase promoter.

Other examples of regulatory sequences are those which allow for gene amplification. In eukaryotic systems, these include the dihydrofolate reductase gene, which is amplified in the presence of methotrexate, and the metallothionein genes, which are amplified with heavy metals. In these cases, the nucleic acid sequence encoding the polypeptide of the present invention would be operably linked with the regulatory sequence.

In another aspect, the present disclosure is also directed to a recombinant expression vector comprising a polynucleotide encoding an engineered imine reductase polypeptide, and one or more expression regulating regions such as a promoter and a terminator, a replication origin, etc., depending on the type of hosts into which they are to be introduced. The various nucleic acid and control sequences described above may be joined together to produce a recombinant expression vector which may include one or more convenient restriction sites to allow for insertion or substitution of the nucleic acid sequence encoding the polypeptide at such sites. Alternatively, the nucleic acid sequence of the present disclosure may be expressed by inserting the nucleic acid sequence or a nucleic acid construct comprising the sequence into an appropriate vector for expression. In creating the expression vector, the coding sequence is located in the vector so that the coding sequence is operably linked with the appropriate control sequences for expression.

The recombinant expression vector may be any vector (e.g., a plasmid or virus), which can be conveniently subjected to recombinant DNA procedures and can bring about the expression of the polynucleotide sequence. The choice of the vector will typically depend on the compatibility of the vector with the host cell into which the vector is to be introduced. The vectors may be linear or closed circular plasmids.

The expression vector may be an autonomously replicating vector, i.e., a vector that exists as an extrachromosomal entity, the replication of which is independent of chromosomal replication, e.g., a plasmid, an extrachromosomal element, a minichromosome, or an artificial chromosome. The vector may contain any means for assuring self-replication. Alternatively, the vector may be one which, when introduced into the host cell, is integrated into the genome and replicated together with the chromosome(s) into which it has been integrated. Furthermore, a single vector or plasmid or two or more vectors or plasmids which together contain the total DNA to be introduced into the genome of the host cell, or a transposon may be used.

The expression vector of the present invention preferably contains one or more selectable markers, which permit easy selection of transformed cells. A selectable marker is a gene the product of which provides for biocide or viral resistance, resistance to heavy metals, prototrophy to auxotrophs, and the like. Examples of bacterial selectable markers are the dal genes from *Bacillus subtilis* or *Bacillus licheniformis*, or markers, which confer antibiotic resistance such as ampicillin, kanamycin, chloramphenicol (Example 1) or tetracycline resistance. Suitable markers for yeast host cells are ADE2, HIS3, LEU2, LYS2, MET3, TRP1, and URA3. Selectable markers for use in a filamentous fungal host cell include, but are not limited to, amdS (acetamidase), argB (ornithine carbamoyltransferase), bar (phosphinothricin acetyltransferase), hph (hygromycin phosphotransferase), niaD (nitrate reductase), pyrG (orotidine-5'-phosphate decarboxylase), sC (sulfate adenyltransferase), and trpC (anthranilate synthase), as well as equivalents thereof. Embodiments for use in an *Aspergillus* cell include the amdS and pyrG genes of *Aspergillus nidulans* or *Aspergillus oryzae* and the bar gene of *Streptomyces hygroscopicus*.

In another aspect, the present disclosure provides a host cell comprising a polynucleotide encoding an improved imine reductase polypeptide of the present disclosure, the polynucleotide being operatively linked to one or more control sequences for expression of the imine reductase enzyme in the host cell. Host cells for use in expressing the polypeptides encoded by the expression vectors of the present invention are well known in the art and include but are not limited to, bacterial cells, such as *E. coli, Bacillus subtilis, Streptomyces* and *Salmonella typhimurium* cells; fungal cells, such as yeast cells (e.g., *Saccharomyces cerevisiae* or *Pichia pastoris* (ATCC Accession No. 201178)); insect cells such as *Drosophila* S2 and *Spodoptera* Sf9 cells; animal cells such as CHO, COS, BHK, 293, and Bowes melanoma cells; and plant cells. Exemplary host cells are *Escherichia coli* W3110 (AfhuA) and BL21.

Appropriate culture mediums and growth conditions for the above-described host cells are well known in the art. Polynucleotides for expression of the imine reductase may be introduced into cells by various methods known in the art. Techniques include among others, electroporation, biolistic particle bombardment, liposome mediated transfection, calcium chloride transfection, and protoplast fusion.

In some embodiments, the polypeptides can be expressed in cell free expression systems, for example those described in Kudlicki et al., Cell Free Expression, 1$^{st}$ Ed., Landes Biosciences (2007) and Cell Free Protein Synthesis: Methods and Protocols, 1$^{st}$ Ed., Spirin et al., eds., Wiley-VCH (2007), all of which are incorporated herein by reference.

In the embodiments herein, the improved polypeptides and corresponding polynucleotides can be obtained using methods used by those skilled in the art. The engineered imine reductases described herein can be obtained by subjecting the polynucleotide encoding the naturally occurring gene encoding the wild-type opine dehydrogenase CENDH (SEQ ID NO: 2) or another engineered imine reductase to mutagenesis and/or directed evolution methods, as discussed above. An exemplary directed evolution technique is mutagenesis and/or directed evolution methods (see, e.g., Stemmer, 1994, Proc Natl Acad Sci USA 91:10747-10751; PCT Publ. Nos. WO 95/22625, WO 97/0078, WO 97/35966, WO 98/27230, WO 00/42651, and WO 01/75767; U.S. Pat. Nos. 6,537,746; 6,117,679; 6,376,246; and 6,586,182; and U.S. Pat. Publ. Nos. 20080220990A1 and 20090312196A1; each of which is hereby incorporated by reference herein). Other directed evolution procedures that can be used include, among others, staggered extension process (StEP), in vitro recombination (Zhao et al., 1998, Nat. Biotechnol. 16:258-261), mutagenic PCR (Caldwell et al., 1994, PCR Methods Appl. 3:S136-S140), and cassette mutagenesis (Black et al., 1996, Proc Natl Acad Sci USA 93:3525-3529). Mutagenesis and directed evolution techniques useful for the purposes herein are also described in the following references: Ling, et al., 1997, Anal. Biochem. 254(2):157-78; Dale et al., 1996, "Oligonucleotide-directed random mutagenesis using the phosphorothioate method," In Methods Mol. Biol. 57:369-74; Smith, 1985, Ann. Rev. Genet. 19:423-462; Botstein et al., 1985, Science 229:1193-1201; Carter, 1986, Biochem. J. 237:1-7; Kramer et al., 1984, Cell, 38:879-887; Wells et al., 1985, Gene 34:315-323; Minshull et al., 1999, Curr Opin Chem Biol 3:284-290; Christians et al., 1999, Nature Biotech 17:259-264; Crameri et al., 1998, Nature 391:288-291; Crameri et al., 1997, Nature Biotech 15:436-438; Zhang et al., 1997, Proc Natl Acad Sci USA 94:45-4-4509; Crameri et al., 1996, Nature Biotech 14:315-319; Stemmer, 1994, Nature 370:389-391; Stemmer, 1994, Proc Natl Acad Sci USA 91:10747-10751; WO 95/22625; WO 97/0078; WO 97/35966; WO 98/27230; WO 00/42651; WO 01/75767 and U.S. Pat. No. 6,537,746. All publications are incorporated herein by reference.

The clones obtained following mutagenesis treatment can be screened for engineered imine reductases having one or more desired improved enzyme properties. For example, where the improved enzyme property desired is increase activity in the conversion of a ketone of compound (1b) and an amine of compound (2b) to a secondary amine of compound (3d), enzyme activity may be measured for production of compound (3d). Clones containing a polynucleotide encoding a imine reductase with the desired characteristics, e.g., increased production of compound (3d), are then isolated, sequenced to identify the nucleotide sequence changes (if any), and used to express the enzyme in a host cell. Measuring enzyme activity from the expression libraries can be performed using the standard biochemistry techniques, such as HPLC analysis and/or derivatization of products (pre or post separation), e.g., with dansyl chloride or OPA.

Where the sequence of the engineered polypeptide is known, the polynucleotides encoding the enzyme can be prepared by standard solid-phase methods, according to known synthetic methods. In some embodiments, fragments of up to about 100 bases can be individually synthesized, then joined (e.g., by enzymatic or chemical litigation methods, or polymerase mediated methods) to form any desired continuous sequence. For example, polynucleotides and oligonucleotides encoding portions of the imine reductase can be prepared by chemical synthesis using, e.g., the classical phosphoramidite method described by Beaucage et al., 1981, Tet Lett 22:1859-69, or the method described by Matthes et al., 1984, EMBO J. 3:801-05, e.g., as it is typically practiced in automated synthetic methods. According to the phosphoramidite method, oligonucleotides are synthesized, e.g., in an automatic DNA synthesizer, purified, annealed, ligated and cloned in appropriate vectors. In addition, essentially any nucleic acid can be obtained from any of a variety of commercial sources. In some embodiments, additional variations can be created by synthesizing oligonucleotides containing deletions, insertions, and/or substitutions, and combining the oligonucleotides in various permutations to create engineered imine reductases with improved properties.

Accordingly, in some embodiments, a method for preparing the engineered imine reductases polypeptide can comprise: (a) synthesizing a polynucleotide encoding a polypeptide comprising an amino acid sequence selected from the even-numbered sequence identifiers SEQ ID NO: 4-100 and 112-750, and having one or more residue differences as compared to SEQ ID NO:2 at residue positions selected from: X4, X5, X14, X20, X29, X37, X67, X71, X74, X82, X94, X97, X100, X111, X124, X136, X137, X141, X143, X149, X153, X154, X156, X157, X158, X160, X163, X177, X178, X183, X184, X185, X186, X197, X198, X201, X220, X223, X226, X232, X243, X246, X256, X258, X259, X260, X261, X265, X266, X270, X273, X274, X277, X279, X280, X283, X284, X287, X288, X292, X293, X294, X295, X296, X297, X308, X311, X323, X324, X326, X328, X332, X353, and X356; and (b) expressing the imine reductase polypeptide encoded by the polynucleotide.

In some embodiments of the method, the residue differences at residue positions X4, X5, X14, X20, X29, X37, X67, X71, X74, X82, X94, X97, X100, X111, X124, X136, X137, X141, X143, X149, X153, X154, X156, X157, X158, X160, X163, X177, X178, X183, X184, X185, X186, X197, X198, X201, X220, X223, X226, X232, X243, X246, X256, X258, X259, X260, X261, X265, X266, X270, X273, X274, X277, X279, X280, X283, X284, X287, X288, X292, X293, X294, X295, X296, X297, X308, X311, X323, X324, X326, X328, X332, X353, and X356 are selected from X4H/L/R; X5T; X14P; X20T; X29R/T; X37H; X67A/D; X71C/V; X74R; X82P; X94K/R/T; X97P; X100W; X111M/Q/R/S; X124L/N; X136G; X137N; X141W; X143W; X149L; X153V/Y; X154F/M/Q/Y; X156G/I/Q/S/T/V; X157D/H/L/M/N/R; X158K; X160N; X163T; X177C/H; X178E; X183C; X184K/Q/R; X185V; X186K/R; X197I/P; X198A/E/H/P/S; X201L; X220D/H; X223T; X226L; X232A/R; X243G; X246W; X256V; X258D; X259E/H/I/L/M/S/T/V/W; X260G; X261A/G/I/K/R/S/T; X265G/L/Y; X266T; X270G; X273W; X274M; X277A/I; X279F/L/V/Y; X280L; X283V; X284K/L/M/Y; X287S/T; X288G/S; X292C/G/I/P/S/T/V/Y; X293H/I/K/L/N/Q/T/V; X294A/I/V; X295R/S; X296L/N/V/ W; X297A; X308F; X311C/T/V; X323C/I/M/T/V; X324L/T; X326V; X328A/G/E; X332V; X353E; and X356R.

In some embodiments of the method, the polynucleotide can encode an engineered imine reductase that has optionally one or several (e.g., up to 3, 4, 5, or up to 10) amino acid residue deletions, insertions and/or substitutions. In some embodiments, the amino acid sequence has optionally 1-2, 1-3, 1-4, 1-5, 1-6, 1-7, 1-8, 1-9, 1-10, 1-15, 1-20, 1-21, 1-22, 1-23, 1-24, 1-25, 1-30, 1-35, 1-40, 1-45, or 1-50 amino acid residue deletions, insertions and/or substitutions. In some embodiments, the number of amino acid sequence has optionally 1, 2, 3, 4, 5, 6, 7, 8, 9, 10, 11, 12, 13, 14, 15, 16, 17, 18, 19, 20, 21, 22, 23, 24, 25, 30, 30, 35, 40, 45, or 50 amino acid residue deletions, insertions and/or substitutions. In some embodiments, the amino acid sequence has optionally 1, 2, 3, 4, 5, 6, 7, 8, 9, 10, 11, 12, 13, 14, 15, 16, 18, 20, 21, 22, 23, 24, or 25 amino acid residue deletions, insertions and/or substitutions. In some embodiments, the substitutions can be conservative or non-conservative substitutions.

In another aspect, the present disclosure provides methods of manufacturing the engineered imine reductase polypeptides, where the method can comprise culturing a host cell capable of expressing a polynucleotide encoding the imine reductase polypeptide under conditions suitable for expression of the polypeptide. The method can further comprise isolating or purifying the expressed imine reductase polypeptide, as described herein.

In some embodiments, the method for preparing or manufacturing the engineered imine reductase polypeptides further comprises the step of isolating the polypeptide. The engineered polypeptides can be expressed in appropriate cells, as described above, and isolated (or recovered) from the host cells, the culture medium, and/or expression medium using any one or more of the well known techniques used for protein purification, including, among others, lysozyme treatment, sonication, filtration, salting-out, ultra-centrifugation, and chromatography. Suitable solutions for lysing and the high efficiency extraction of proteins from bacteria, such as *E. coli*, are commercially available, such as CelLytic B™ from Sigma-Aldrich of St. Louis Mo. Chromatographic techniques for isolation of the imine reductase polypeptides include, among others, reverse phase chromatography high performance liquid chromatography, ion exchange chromatography, gel electrophoresis, and affinity chromatography.

In some embodiments, the non-naturally occurring polypeptides of the disclosure can be prepared and used in various forms including but not limited to crude extracts (e.g., cell-free lysates), powders (e.g., shake-flask powders), lyophilizates, and substantially pure preparations (e.g., DSP powders), as further illustrated in the Examples below.

In some embodiments, the engineered polypeptides can be prepared and used in purified form, for example a substantially purified form. Generally, conditions for purifying a particular polypeptide will depend, in part, on factors such as net charge, hydrophobicity, hydrophilicity, molecular weight, molecular shape, etc., and will be apparent to those having skill in the art. To facilitate purification, it is contemplated that in some embodiments the engineered polypeptides can be expressed as fusion proteins with purification tags, such as His-tags having affinity for metals, or antibody tags for binding to antibodies, e.g., myc epitope tag.

In some embodiments, affinity techniques may be used to isolate the improved imine reductase enzymes. For affinity chromatography purification, any antibody which specifically binds the imine reductase polypeptide may be used. For the production of antibodies, various host animals, including but not limited to rabbits, mice, rats, etc., may be immunized by injection with a imine reductase polypeptide, or a fragment thereof. The imine reductase polypeptide or fragment may be attached to a suitable carrier, such as BSA, by means of a side chain functional group or linkers attached to a side chain functional group. In some embodiments, the affinity purification can use a specific ligand bound by the imine reductase, such as poly(L-proline) or dye affinity column (see, e.g., EP0641862; Stellwagen, E., 2001, "Dye Affinity Chromatography," In Current Protocols in Protein Science Unit 9.2-9.2.16).

6.5 Methods of Using the Engineered Imine Reductase Enzymes

In another aspect, the engineered polypeptides having imine reductase activity described herein can be used in a process for converting a compound of formula (I) and a compound of formula (II) to a secondary or tertiary amine compound of formula (III) as described above and illustrated in Scheme 1. Generally, such a biocatalytic process for carrying out the reductive amination reaction of Scheme 1 comprises contacting or incubating the ketone and amine substrate compounds with an engineered polypeptide having imine reductase activity of the disclosure in the presence of a cofactor, such as NADH or NADPH, under reaction conditions suitable for formation of the amine product compound of formula (III).

In some embodiments, the imine reductases can be used in a process for preparing a secondary or tertiary amine product compound of formula (III),

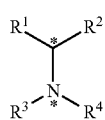
(III)

wherein, $R^1$ and $R^2$ groups are independently selected from optionally substituted alkyl, alkenyl, alkynyl, alkoxy, carboxy, aminocarbonyl, heteroalkyl, heteroalkenyl, heteroalkynyl, carboxyalkyl, aminoalkyl, haloalkyl, alkylthioalkyl, cycloalkyl, aryl, arylalkyl, heterocycloalkyl, heteroaryl, and heteroarylalkyl; and optionally $R^1$ and $R^2$ are linked to form a 3-membered to 10-membered ring; $R^3$ and $R^4$ groups are independently selected from a hydrogen atom, and optionally substituted alkyl, alkenyl, alkynyl, alkoxy, carboxy, aminocarbonyl, heteroalkyl, heteroalkenyl, heteroalkynyl, carboxyalkyl, aminoalkyl, haloalkyl, alkylthioalkyl, cycloalkyl, aryl, arylalkyl, heterocycloalkyl, heteroaryl, and heteroarylalkyl, with the proviso that both $R^3$ and $R^4$ cannot be hydrogen; and optionally $R^3$ and $R^4$ are linked to form a 3-membered to 10-membered ring; and optionally, the carbon atom and/or the nitrogen indicated by * is chiral. The process comprises contacting a ketone compound of formula (I),

(I)

wherein $R^1$, and $R^2$ are as defined above; and an amine compound of formula (II),

(II)

wherein $R^3$, and $R^4$ are as defined above; with an engineered polypeptide having imine reductase activity in presence of a cofactor under suitable reaction conditions.

As illustrated by the reactions in Table 2, and Tables 3A-3J, the engineered polypeptides having imine reductase activity of the present disclosure have activity with, or can be further engineered to have activity with, a wide range of amine substrate compounds of formula (II) in a process for preparing compound of formula (III). Accordingly, in some embodiments of the above biocatalytic process for preparing a secondary or tertiary amine product compound of formula (III), the compound of formula (II) can be a primary amine wherein at least one of $R^3$ and $R^4$ is hydrogen, whereby the product of formula (III) is a secondary amine compound. In some embodiments of the process, neither $R^3$ or $R^4$ is hydrogen and the compound of formula (II) is a secondary amine, whereby the compound of formula (III) is tertiary amine. In some embodiments of the process, the compound of formula (II) is a secondary amine and $R^3$ or $R^4$ are different, whereby the nitrogen atom indicated by * of the amine compound of formula (III) is chiral. Further, in some embodiments, one stereoisomer of the chiral amine compound of formula (III) is formed stereoselectively, and optionally formed highly stereoselectively (e.g., in at least about 85% stereomeric excess).

In some embodiments of the biocatalytic process for preparing a secondary or tertiary amine product compound of formula (III), the $R^3$ and $R^4$ groups of the compound of formula (II) are linked to form a 3-membered to 10-membered ring. In some embodiments, the ring is a 5-membered to 8-membered is an optionally substituted cycloalkyl, aryl, arylalkyl, heterocycloalkyl, heteroaryl, or heteroarylalkyl ring.

In some embodiments of the biocatalytic process for preparing an amine product compound of formula (III), the compound of formula (II) is a primary amine, wherein $R^3$ group is hydrogen, and $R^4$ is selected from optionally substituted ($C_1$-$C_6$)alkyl, ($C_1$-$C_6$)alkenyl, ($C_1$-$C_6$)alkynyl, ($C_1$-$C_6$)carboxyalkyl, ($C_1$-$C_6$)aminoalkyl, ($C_1$-$C_6$)haloalkyl, and ($C_1$-$C_6$)alkylthioalkyl. In some embodiments, the $R^4$ group is selected from optionally substituted ($C_1$-$C_6$)alkyl, ($C_1$-$C_6$)carboxyalkyl, and ($C_1$-$C_6$)aminoalkyl. In some embodiments, the $R^4$ group is optionally substituted ($C_1$-$C_6$)alkyl, or ($C_1$-$C_6$)carboxyalkyl. In some embodiments, the compound of formula (II) is selected from methylamine, dimethylamine, isopropylamine, butylamine, and isobutylamine. In some embodiments, the amine substrate compound $R^3$ group is hydrogen, and $R^4$ is selected from optionally substituted ($C_4$-$C_8$)cycloalkyl, ($C_4$-$C_8$)heterocycloalkyl, ($C_4$-$C_8$)aryl, ($C_4$-$C_8$)arylalkyl, ($C_4$-$C_8$)heteroaryl, and ($C_4$-$C_8$)heteroarylalkyl. In some embodiments, the amine substrate compound $R^3$ group is hydrogen, and $R^4$ is selected from optionally substituted ($C_4$-$C_8$)aryl, ($C_4$-$C_8$)arylalkyl, ($C_4$-$C_8$)heteroaryl, and ($C_4$-$C_8$)heteroarylalkyl. In some embodiments, the amine substrate compound $R^3$ group is hydrogen, and $R^4$ is optionally substituted ($C_4$-$C_8$)aryl. In some embodiments, the compound of formula (II) is optionally substituted aniline.

As illustrated by the reactions in Table 2, and Tables 3A-3J, the engineered polypeptides having imine reductase activity of the present disclosure have activity with, or can be further engineered to have activity with, a wide range of ketone substrate compounds of formula (I) in a process for preparing compound of formula (III). In some embodiments, the $R^1$ and $R^2$ groups of the ketone substrate of compound (1) are different, whereby the carbon atom indicated by * of the amine compound of formula (III) is chiral. Further, in some embodiments of the process, one stereoisomer of the chiral amine compound of formula (III) is formed stereos electively, and optionally formed highly stereos electively (e.g., in at least about 85% stereomeric excess).

In some embodiments of the biocatalytic process for preparing a secondary or tertiary amine product compound of formula (III), the $R^1$ and $R^2$ groups of the compound of formula (I) are linked to form a 3-membered to 10-membered ring. In some embodiments, the ring is an optionally substituted cycloalkyl, aryl, arylalkyl, heterocycloalkyl, heteroaryl, or heteroarylalkyl ring. In some embodiments of the process, the compound of formula (I) is selected from optionally substituted cyclobutanone, cyclopentanone, cyclohexanone, and cycloheptanone.

In some embodiments of the biocatalytic process for preparing a secondary or tertiary amine product compound of formula (III), the $R^1$ and $R^2$ groups of the compound of formula (I) are independently selected from optionally substituted ($C_1$-$C_6$)alkyl, ($C_1$-$C_6$)alkenyl, ($C_1$-$C_6$)alkynyl, ($C_1$-$C_6$)carboxyalkyl, ($C_1$-$C_6$)aminoalkyl, ($C_1$-$C_6$)haloalkyl, and ($C_1$-$C_6$)alkylthioalkyl.

In some embodiments of the biocatalytic process for preparing a secondary or tertiary amine product compound of formula (III), the $R^1$ group of the compound of formula (I) is selected from optionally substituted ($C_1$-$C_6$)alkyl, ($C_1$-$C_6$)alkenyl, ($C_1$-$C_6$)alkynyl, ($C_1$-$C_6$)carboxyalkyl, ($C_1$-$C_6$)aminoalkyl, ($C_1$-$C_6$)haloalkyl, and ($C_1$-$C_6$)alkylthioalkyl; and the $R^2$ group of the compound of formula (I) is selected from optionally substituted ($C_4$-$C_8$)cycloalkyl, ($C_4$-$C_8$)heterocloalkyl, ($C_4$-$C_8$)arylalkyl, ($C_4$-$C_8$)heteroaryl, and ($C_4$-$C_8$)heteroarylalkyl.

In some embodiments of the biocatalytic process for preparing a secondary or tertiary amine product compound of formula (III), the $R^1$ group of the compound of formula (I) is carboxy. In some embodiments, the compound of formula (I) is a 2-keto-acid selected from pyruvic acid, 2-oxo-propanoic acid, 2-oxo-butanoic acid, 2-oxo-pentanoic acid, 2-oxo-hexanoic acid.

In some embodiments of the biocatalytic process for preparing a secondary or tertiary amine product compound of formula (III), the $R^1$ group of the compound of formula (I) is a hydrogen atom, and the compound of formula (I) is an aldehyde. In such embodiments, the $R^1$ group of the compound of formula (I) is selected from optionally substituted alkyl, alkenyl, alkynyl, alkoxy, carboxy, aminocarbonyl, heteroalkyl, heteroalkenyl, heteroalkynyl, carboxyalkyl, aminoalkyl, haloalkyl, alkylthioalkyl, cycloalkyl, aryl, arylalkyl, heterocycloalkyl, heteroaryl, and heteroarylalkyl.

As illustrated by the compounds of formulas (I), (II), and (III), listed for the reactions in Table 2, in some embodiments of the above biocatalytic process for preparing a secondary or tertiary amine product compound of formula (III), the product compound of formula (III) comprises a compound selected from group consisting of: compound (3a), compound (3b), compound (3c), compound (3d), compound (3e), compound (3f), compound (3g), compound (3h), compound (3i), compound (3j), compound (3k), compound (3l), compound (3m), compound (3n), and compound (3o). In some embodiments of the process, the compound of formula (I) comprises a compound selected from group consisting of: compound (1a), compound (1b), compound (1c), compound (1d), compound (1e), compound (1f), compound (1g), compound (1h), compound (1i), and compound (1j). In some embodiments of the process, the compound of formula (II) comprises a compound selected from group consisting of: compound (2a), compound (2b), compound (2c), compound (2d), compound (2e), and compound (2f).

It is also contemplated that in some embodiments the process for preparing an amine product compound of formula (III) catalyzed by an engineered polypeptide having imine reductase activity of the present disclosure comprises an intramolecular reaction, wherein the compound of formula (I) and the compound of formula (II) are groups on the same, single molecule. Thus, in some embodiments, at least one of $R^1$ and $R^2$ of the ketone compound of formula (I) is linked to at least one of $R^3$ and $R^4$ of the amine compound of formula (II), and the method comprises contacting the single compound with a ketone group of formula (I) linked to an amine group of formula (II) with an engineered polypeptide of the present disclosure under suitable reaction conditions. Illustrative intramolecular reactions include but are not limited to reactions of Schemes 2-5 shown below in Table 4, wherein groups $R_1$ and $R_3$ are as defined above for groups $R^1$ and $R^3$, and group $R_5$ is selected from a hydrogen atom, and optionally substituted alkyl, alkenyl, alkynyl, alkoxy, carboxy, aminocarbonyl, heteroalkyl, heteroalkenyl, heteroalkynyl, carboxyalkyl, aminoalkyl, haloalkyl, alkylthioalkyl, cycloalkyl, aryl, arylalkyl, heterocycloalkyl, heteroaryl, and heteroarylalkyl.

TABLE 4

Scheme 2

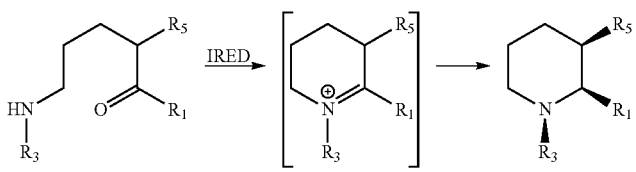

Scheme 3

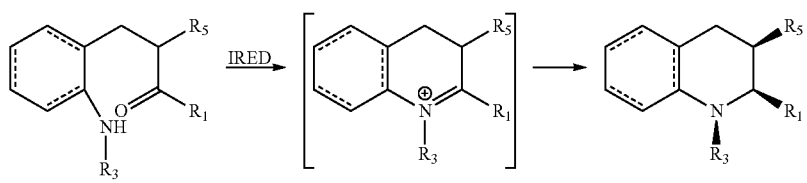

Scheme 4

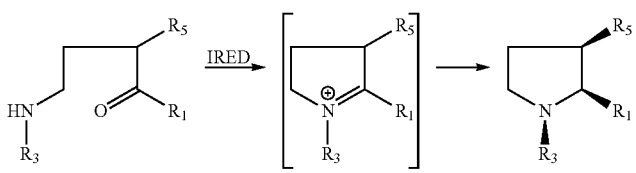

Scheme 5

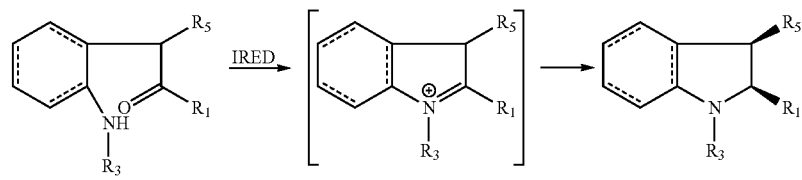

Without being bound by theory, it is believed that in most cases the biocatalytic reaction of Scheme 1 involves the formation of an intermediate imine compound (e.g., an iminium intermediate) which is then further reduced by the enzyme to the final secondary or tertiary amine product compound of formula (III). It is also contemplated that in some embodiments, the process for preparing an amine product compound of formula (III) catalyzed by an engineered polypeptide having imine reductase activity of the present disclosure comprises contacting an engineered imine reductase polypeptide of the present disclosure with a ketone compound of formula (I) and a primary amine compound of formula (II), whereby an imine intermediate is formed which then undergoes an intramolecular asymmetric cyclization reaction to yield a cyclic secondary or tertiary hydroxyamine intermediate which undergoes hydroxyl elimination to give a second imine (or enamine) intermediate. This second imine (or enamine) is subsequently is then reduced in situ by the engineered imine reductase polypeptide of the present disclosure to yield the final cyclic amine product. Illustrative reactions involving asymmetric cyclization through a hydroxyamine intermediate include but are not limited to reactions of Schemes 6-9 shown below in Table 5, wherein groups $R_1$ and $R_3$ are as defined above for groups $R^1$ and $R^3$, and groups $R_5$, $R_6$, and $R_7$ are independently selected from a hydrogen atom, and optionally substituted alkyl, alkenyl, alkynyl, alkoxy, carboxy, aminocarbonyl, heteroalkyl, heteroalkenyl, heteroalkynyl, carboxyalkyl, aminoalkyl, haloalkyl, alkylthioalkyl, cycloalkyl, aryl, arylalkyl, heterocycloalkyl, heteroaryl, and heteroarylalkyl.

TABLE 5

Scheme 6

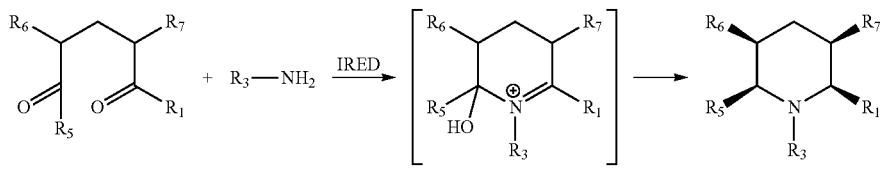

Scheme 7

TABLE 5-continued

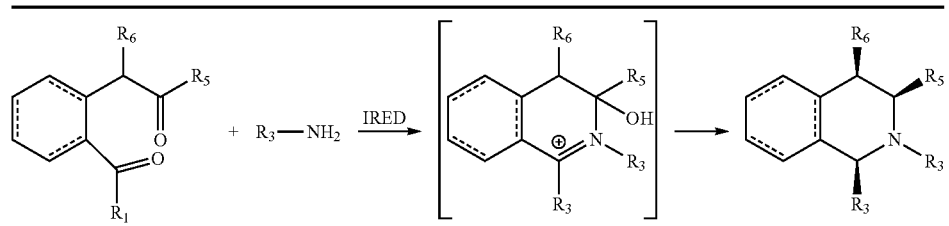

Scheme 8

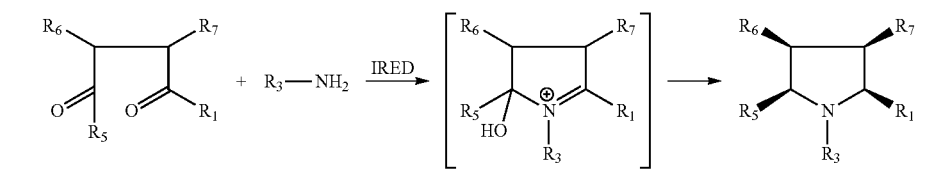

Scheme 9

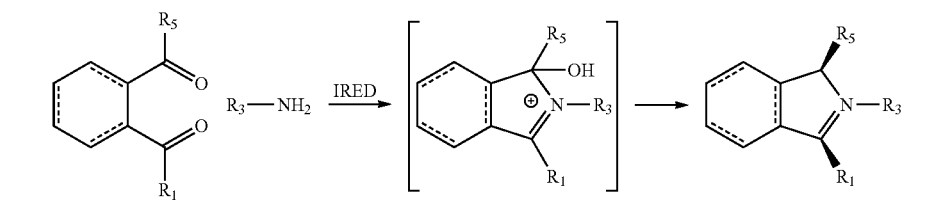

Without being bound by theory, it is believed that the engineered polypeptides having imine reductase activity (IREDs) mediate not only the formation of the imine and/or hydroxyamine intermediates as shown in the reactions of Schemes 2-9 but also the conversion of the imine intermediates to the final amine product compound of formula (III) depicted by the second reaction arrow.

Generally, imine compounds are less stable than amine compounds and susceptible to undesirable oxidation reactions. It is contemplated, however, that in some embodiments of the processes of the present disclosure, an imine compound, or an enamine compound which can tautomerize to form an imine, can form from a ketone of formula (I) and an amine compound of formula (II) absent the presence of an enzyme, and then be contacted with an engineered polypeptide of the present disclosure to catalyze its conversion of the final to a secondary or tertiary amine product compound of formula (III). For example, an imine or enamine intermediate compound first can be formed by combining a ketone of formula (I) and an amine compound of formula (II) as shown in Schemes 6-9 but without the presence of an IRED (i.e., an engineered polypeptide having imine reductase activity). The imine compound formed directly or from tautomerization of an enamine compound can then be contacted with an engineered polypeptide having imine reductase activity to catalyze the conversion to the final amine product compound of formula (III). In some embodiments, it is contemplated that the imine or enamine intermediate compound, where suitably stable, can be isolated before carrying out a step of contacting it with an engineered polypeptide having imine reductase activity. Thus, it is contemplated that in some embodiments of the process, an imine or enamine compound is formed first from the compounds of formula (I) and formula (II), or through the intramolecular reaction of compound having a ketone group linked to an amine group, and then this imine or enamine compound is contacted with an engineered polypeptide having imine reductase activity to form an amine product compound of formula (III).

In some embodiments, a stable imine or enamine compound may be obtained (i.e., without first reacting a ketone compound of formula (I) and an amine compound of formula (II)) and used directly as a substrate with an IRED. It is contemplated that in such embodiments, the biocatalytic process is carried out wherein there is only a single substrate which is a stable imine or enamine compound, and this compound is contacted with an engineered polypeptide having imine reductase activity of the present disclosure which catalyzes the reduction of the stable imine compound to form a secondary compound of formula (III). In such a reaction, the stereoselectivity of the engineered polypeptide can mediate the formation of a chiral center adjacent to the amine group of the compound of formula (III). Table 6 (below) lists three examples of stable imine compounds that can undergo chiral reduction in a biocatalytic process with an engineered polypeptide of the present disclosure to produce intermediate compounds for the synthesis of the pharmaceuticals solifenacin and tadalafil, and for the synthesis of the pharmaceutical compound, dexmethylphenidate.

TABLE 6

| Imine or Enamine Substrate Compound | Product Compound of formula (III) |
|---|---|
| (3,4-dihydroisoquinoline with Ph at C1) | (1,2,3,4-tetrahydroisoquinoline with Ph at C1) — solifenacin (Vessicare) synthesis intermediate |
| (dihydro-β-carboline with benzodioxole and CO₂Et) | (tetrahydro-β-carboline with benzodioxole and CO₂Et) — tadalafil synthesis intermediate |
| (piperidine enamine with Ph and CO₂Me) | (piperidine with Ph and CO₂Me) — dexmethylphenidate |

Alternatively, it is also contemplated that any of the product compounds of formula (III) produced via an IRED catalyzed reaction of an isolated imine or enamine substrate compound (as shown in Table 6) could also be produced via an IRED-catalyzed intramolecular reaction (like those illustrated in Table 4) using as substrate the open-chain version of the imine or enamine substrate compounds. Accordingly, each of the product compounds of Table 6 could also be made using the intermolecular substrate shown in Table 7 with an engineered polypeptide having imine reductase activity of the present disclosure.

TABLE 7

| Intermolecular Substrate Compound (comprising formula (I) and formula (II)) | Product Compound of formula (III) |
|---|---|
| (2-(2-aminoethyl)phenyl phenyl ketone) | (1-phenyl-1,2,3,4-tetrahydroisoquinoline) — Solifenacin synthesis intermediate |
| (tryptophan ethyl ester + piperonyl ketone) | (tetrahydro-β-carboline with benzodioxole and CO₂Et) — tadalafil synthesis intermediate |
| (amino ketone with Ph and CO₂Me) | (piperidine with Ph and CO₂Me) — dexmethylphenidate |

There are numerous active pharmaceutical ingredient compounds that include a secondary or tertiary amine group which could be produced via a biocatalytic reductive amination using an engineered polypeptide having imine reductase activity of the present disclosure, and/or an engineered polypeptide produced by further directed evolution of an engineered polypeptide of the present disclosure. For example, Table 8 lists various product compounds of formula (III) that are known active pharmaceutical ingredient compounds, or intermediate compounds useful for the synthesis of active pharmaceutical ingredient compounds, that could be produced using an engineered polypeptide having imine reductase activity of the present disclosure with the corresponding substrates compounds of formula (I) and/or formula (II).

TABLE 8

| Substrate Compound of formula (I) | Substrate Compound of formula (II) | Product Compound of formula (III) |
|---|---|---|
| methyl 2-(2-chlorophenyl)-2-oxoacetate | 4,5,6,7-tetrahydrothieno[3,2-c]pyridine | clopidogrel |

TABLE 8-continued
| Substrate Compound of formula (I) | Substrate Compound of formula (II) | Product Compound of formula (III) |
|---|---|---|
| 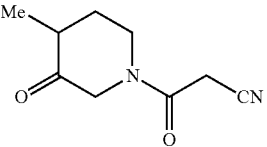 [SMILES: CC1CCN(C(=O)CC#N)CC1=O] | 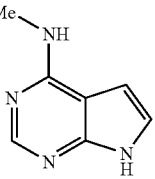 | 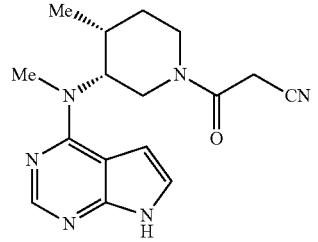
tofacitinib |
| 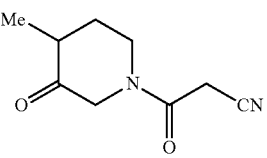 [SMILES: CC1CCN(C(=O)CC#N)CC1=O] |  | 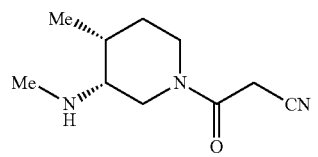
tofacitinib synthesis intermediate |
| 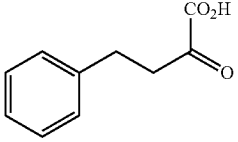 [SMILES: O=C(O)C(=O)CCc1ccccc1] | 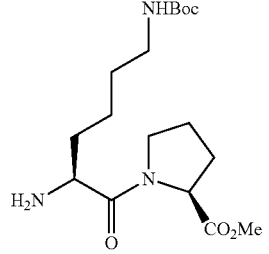 [SMILES: COC(=O)[C@@H]1CCCN1C(=O)[C@@H](N)CCCCNC(=O)OC(C)(C)C] | 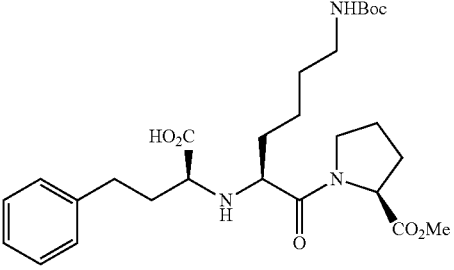 [SMILES: COC(=O)[C@@H]1CCCN1C(=O)[C@H](CCCCNC(=O)OC(C)(C)C)N[C@@H](CCc1ccccc1)C(=O)O]
lisinopril synthesis intermediate |
| 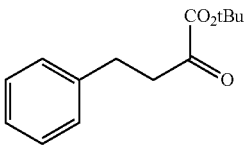 [SMILES: CC(C)(C)OC(=O)C(=O)CCc1ccccc1] | 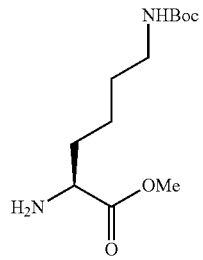 | 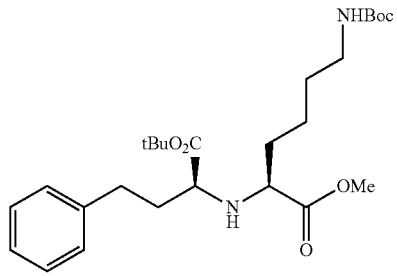 [SMILES: COC(=O)[C@H](CCCCNC(=O)OC(C)(C)C)N[C@@H](CCc1ccccc1)C(=O)OC(C)(C)C]
lisinopril synthesis intermediate |
| 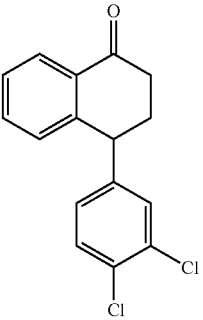 [SMILES: O=C1CCC(c2ccc(Cl)c(Cl)c2)c2ccccc21] |  | 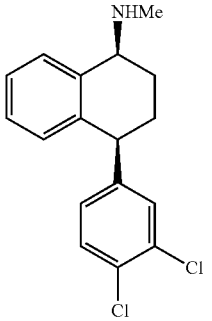 [SMILES: CN[C@H]1CC[C@@H](c2ccc(Cl)c(Cl)c2)c2ccccc21]
sertraline |

TABLE 8-continued

| Substrate Compound of formula (I) | Substrate Compound of formula (II) | Product Compound of formula (III) |
| --- | --- | --- |
| 5-hydroxy-2-tetralone | N-propyl-2-(thiophen-2-yl)ethylamine | rotigotine |
| 2-methoxy-5-(2-oxopropyl)benzenesulfonamide | 2-(2-ethoxyphenoxy)ethylamine | tamulosin |
| 2-amino-6,7-dihydrobenzothiazol-6(5H)-one | propylamine | pramipexole |
| dorzolamide ketone precursor | ethylamine | dorzolamide |
| brinzolamide ketone precursor | ethylamine | brinzolamide |
| 1-acetylnaphthalene | 3-(3-trifluoromethylphenyl)propylamine | cinacalcet |

TABLE 8-continued

| Substrate Compound of formula (I) | Substrate Compound of formula (II) | Product Compound of formula (III) |
|---|---|---|
| [structure] | Me₂NH | [structure] dapoxetine |
| [structure] | Me₂NH | [structure] rivastigmine synthesis intermediate |
| [structure] | Me₂NH | [structure] rivastigmine |

In some embodiments of the above biocatalytic process for preparing a secondary or tertiary amine product compound of formula (III), the engineered polypeptide having imine reductase activity is derived from a naturally occurring opine dehydrogenase. In some embodiments, the naturally occurring opine dehydrogenase is selected from: opine dehydrogenase from *Arthrobacter* sp. strain 1C (SEQ ID NO: 2), D-octopine dehydrogenase from *Pecten maximus* (SEQ ID NO: 102), ornithine dehydrogenase from *Lactococcus* lactis K1 (SEQ ID NO: 104), N-methyl-L-amino acid dehydrogenase from *Pseudomonas putida* (SEQ ID NO: 106), β-alanopine dehydrogenase from *Cellana grata* (SEQ ID NO: 108), and tauropine dehydrogenase from *Suberites domuncula* (SEQ ID NO: 110). In some embodiments, the engineered polypeptide having imine reductase activity is an engineered polypeptide derived from the opine dehydrogenase from *Arthrobacter* sp. strain 1C of SEQ ID NO: 2, as disclosed herein, and exemplified by the engineered imine reductase polypeptides of even numbered sequence identifiers SEQ ID NO: 4-100 and 112-750.

Any of the engineered imine reductases described herein can be used in the above biocatalytic processes for preparing a secondary or tertiary amine compound of formula (III). By way of example and without limitation, in some embodiments, the process can use an engineered imine reductase polypeptide comprising an amino acid sequence having at least 80%, 85%, 86%, 87%, 88%, 89%, 90%, 91%, 92%, 93%, 94%, 95%, 96%, 97%, 98%, 99% or more identity to a reference sequence selected from even-numbered sequence identifiers SEQ ID NO: 4-100 and 112-750. In some embodiments of the processes, the engineered imine reductase polypeptide comprises an amino acid sequence having one or more residue differences as compared to SEQ ID NO: 2 at residue positions X4, X5, X14, X20, X29, X37, X67, X71, X74, X82, X94, X97, X100, X111, X124, X136, X137, X141, X143, X149, X153, X154, X156, X157, X158, X160, X163, X177, X178, X183, X184, X185, X186, X197, X198, X201, X220, X223, X226, X232, X243, X246, X256, X258, X259, X260, X261, X265, X266, X270, X273, X274, X277, X279, X280, X283, X284, X287, X288, X292, X293, X294, X295, X296, X297, X308, X311, X323, X324, X326, X328, X332, X353, and X356. In some embodiments of the processes, the residue differences at residue positions X4, X5, X14, X20, X29, X37, X67, X71, X74, X82, X94, X97, X100, X111, X124, X136, X137, X141, X143, X149, X153, X154, X156, X157, X158, X160, X163, X177, X178, X183, X184, X185, X186, X197, X198, X201, X220, X223, X226, X232, X243, X246, X256, X258, X259, X260, X261, X265, X266, X270, X273, X274, X277, X279, X280, X283, X284, X287, X288, X292, X293, X294, X295, X296, X297, X308, X311, X323, X324, X326, X328, X332, X353, and X356 are selected from X4H/L/R; X5T; X14P; X20T; X29R/T; X37H; X67A/D; X71C/V; X74R; X82P; X94K/R/T; X97P; X100W; X111M/Q/R/S; X124L/N; X136G; X137N; X141W; X143W; X149L; X153V/Y; X154F/M/Q/Y; X156G/I/Q/S/T/V; X157D/H/L/M/N/R; X158K; X160N; X163T; X177C/H; X178E; X183C; X184K/Q/R; X185V; X186K/R; X197I/P; X198A/E/H/P/S; X201L; X220D/H; X223T; X226L; X232A/R; X243G; X246W; X256V; X258D; X259E/H/I/L/M/S/T/V/W; X260G; X261A/G/I/K/R/S/T; X265G/L/Y; X266T; X270G; X273W; X274M; X277A/I; X279F/L/V/Y; X280L; X283V; X284K/L/M/Y; X287S/T; X288G/S; X292C/G/I/P/S/T/V/Y; X293H/I/K/L/N/Q/T/V; X294A/I/V; X295R/S; X296L/N/V/W; X297A; X308F; X311C/T/V; X323C/I/M/T/V; X324L/T; X326V; X328A/G/E; X332V; X353E; and X356R.

In some embodiments of the above processes, the exemplary imine reductases capable of carrying out the conversion reactions (a)-(o) of Table 2 disclosed herein, can be used. This includes the engineered polypeptides disclosed herein comprising an amino acid sequence selected from even-numbered sequence identifiers SEQ ID NO: 4-100 and 112-750. Guidance on the choice and use of the engineered imine reductases is provided in the descriptions herein, for example Tables 3A-3J, and the Examples.

In the embodiments herein and illustrated in the Examples, various ranges of suitable reaction conditions that can be used in the processes, include but are not limited to, substrate loading, cofactor loading, polypeptide loading, pH, temperature, buffer, solvent system, reaction time, and/or conditions with the polypeptide immobilized on a solid support. Further suitable reaction conditions for carrying out the process for biocatalytic conversion of substrate compounds to product compounds using an engineered imine reductase polypeptide described herein can be readily optimized in view of the guidance provided herein by routine experimentation that includes, but is not limited to, contacting the engineered imine reductase polypeptide and ketone and amine substrate compounds of interest under experimental reaction conditions of concentration, pH, temperature, and solvent conditions, and detecting the product compound.

Generally, in the processes of the present disclosure, suitable reaction conditions include the presence of cofactor molecule which can act as an electron donor in the reduction reaction carried out by the imine reductase. In some embodiments, the cofactor is selected from (but not limited to) $NADP^+$ (nicotinamide adenine dinucleotide phosphate), NADPH (the reduced form of $NADP^+$), $NAD^+$ (nicotinamide adenine dinucleotide) and NADH (the reduced form of $NAD^+$). Generally, the reduced form of the cofactor is added to the enzyme reaction mixture. Accordingly, in some embodiments, the processes are carried out in presence of a cofactor selected from NADPH and NADH (these two cofactors are also referred to herein collectively as "NAD(P)H"). In some embodiments, the electron donor is NADPH cofactor. In some embodiments, the process can be carried out wherein the reaction conditions comprise an NADH or NADPH cofactor concentration of about 0.03 to about 1 g/L, 0.03 to about 0.8 g/L, about 0.03 to about 0.5 g/L, about 0.05 to about 0.3 g/L, about 0.05 to about 0.2 g/L, or about 0.1 to about 0.2 g/L. In some embodiments, the process is carried out under NADH or NADPH cofactor concentration of about 1 g/L, about 0.8 g/L, about 0.5 g/L, about 0.3 g/L, about 0.2 g/L, about 0.1 g/L, about 0.05 g/L, or about 0.03 g/L.

In some embodiments of the process, an optional cofactor recycling system, also referred to as a cofactor regeneration system, can be used to regenerate cofactor NADPH/NADH from NADP+/NAD+ produced in the enzymatic reaction. A cofactor regeneration system refers to a set of reactants that participate in a reaction that reduces the oxidized form of the cofactor (e.g., $NADP^+$ to NADPH). Cofactors oxidized by the polypeptide reduction of the keto substrate are regenerated in reduced form by the cofactor regeneration system. Cofactor regeneration systems comprise a stoichiometric reductant that is a source of reducing hydrogen equivalents and is capable of reducing the oxidized form of the cofactor. The cofactor regeneration system may further comprise a catalyst, for example an enzyme catalyst, that catalyzes the reduction of the oxidized form of the cofactor by the reductant. Cofactor regeneration systems to regenerate NADH or NADPH from $NAD^+$ or $NADP^+$, respectively, are known in the art and can be used in the methods described herein.

Suitable exemplary cofactor regeneration systems that may be employed in the imine reductase processes of the present disclosure include, but are not limited to, formate and formate dehydrogenase, glucose and glucose dehydrogenase, glucose-6-phosphate and glucose-6-phosphate dehydrogenase, a secondary alcohol and alcohol dehydrogenase, phosphite and phosphite dehydrogenase, molecular hydrogen and hydrogenase, and the like. These systems may be used in combination with either $NADP^+$/NADPH or $NAD^+$/NADH as the cofactor. Electrochemical regeneration using hydrogenase may also be used as a cofactor regeneration system. See, e.g., U.S. Pat. Nos. 5,538,867 and 6,495,023, both of which are incorporated herein by reference. Chemical cofactor regeneration systems comprising a metal catalyst and a reducing agent (for example, molecular hydrogen or formate) may also be suitable. See, e.g., PCT publication WO 2000/053731, which is incorporated herein by reference.

In some embodiments, the co-factor regenerating system comprises a formate dehydrogenase, which is a $NAD^+$ or $NADP^+$-dependent enzyme that catalyzes the conversion of formate and $NAD^+$ or $NADP^+$ to carbon dioxide and NADH or NADPH, respectively. Formate dehydrogenases suitable for use as cofactor regenerating systems in the imine reductase processes described herein include naturally occurring and non-naturally occurring formate dehydrogenases. Suitable formate dehydrogenases are described in PCT publication WO 2005/018579, incorporated herein by reference. In one embodiment, the formate dehydrogenase used in the process is FDH-101, which commercially available (Codexis, Inc. Redwood City, Calif., USA). Formate may be provided in the form of a salt, typically an alkali or ammonium salt (for example, $HCO_2Na$, $KHCO_2NH_4$, and the like), in the form of formic acid, typically aqueous formic acid, or mixtures thereof. A base or buffer may be used to provide the desired pH.

In some embodiments, the cofactor recycling system comprises glucose dehydrogenase (GDH), which is a $NAD^+$ or $NADP^+$-dependent enzyme that catalyzes the conversion of D-glucose and $NAD^+$ or $NADP^+$ to gluconic acid and NADH or NADPH, respectively. Glucose dehydrogenases suitable for use in the practice of the imine reductase processes described herein include naturally occurring glucose dehydrogenases as well as non-naturally occurring glucose dehydrogenases. Naturally occurring glucose dehydrogenase encoding genes have been reported in the literature, e.g., the *Bacillus subtilis* 61297 GDH gene, *B. cereus* ATCC 14579 and *B. megaterium*. Non-naturally occurring glucose dehydrogenases generated using, for example, mutagenesis, directed evolution, and the like and are provided in PCT publication WO 2005/018579, and US publication Nos. 2005/0095619 and 2005/0153417. All of these sequences are incorporated herein by reference. In one embodiment, the glucose dehydrogenase used in the process is CDX-901 or GDH-105, each of which commercially available (Codexis, Inc. Redwood City, Calif., USA).

In some embodiments, the co-factor regenerating system comprises an alcohol dehydrogenase or ketoreductase, which is an $NAD^+$ or $NADP^+$-dependent enzyme that catalyzes the conversion of a secondary alcohol and $NAD^+$ or $NADP^+$ to a ketone and NADH or NADPH, respectively. Suitable secondary alcohols useful in cofactor regenerating systems include lower secondary alkanols and aryl-alkyl carbinols, including but not limited to, isopropanol, 2-butanol, 3-methyl-2-butanol, 2-pentanol, 3-pentanol, 3,3-dimethyl-2-butanol, and the like. Alcohol dehydrogenases suitable for use as cofactor regenerating systems in the processes described herein include naturally occurring and non-naturally occurring ketoreductases. Naturally occurring alcohol dehydrogenase/ketoreductase include known enzymes from, by way of example and not limitation, *Thermoanerobium brockii, Rhodococcus erythropolis, Lactobacillus kefir*, and *Lactobacillus brevis*, and non-naturally occurring alcohol dehydrogenases include engineered alcohol dehydrogenases derived therefrom. In some embodiments, non-naturally occurring ketoreductases engineered for thermo- and solvent stability can be used. Such ketoreductases are described in the present application and the patent publications US 20080318295A1; US 20090093031A1; US 20090155863A1; US 20090162909A1; US 20090191605A1; US 20100055751A1; WO/2010/025238A2; WO/2010/025287A2; and US 20100062499A1; each of which are incorporated by reference herein.

The concentration of the ketone and amine substrate compounds in the reaction mixtures can be varied, taking into consideration, for example, the desired amount of product compound, the effect of substrate concentration on enzyme activity, stability of enzyme under reaction conditions, and the percent conversion of the substrates to the product. In some embodiments, the suitable reaction conditions comprise a substrate compound loading of at least about 0.5 to about 200 g/L, 1 to about 200 g/L, 5 to about 150 g/L, about 10 to about 100 g/L, 20 to about 100 g/L or about 50 to about 100 g/L. In some embodiments, the suitable reaction conditions comprise loading of each of the ketone and amine substrate compounds of at least about 0.5 g/L, at least about 1 g/L, at least about 5 g/L, at least about 10 g/L, at least about 15 g/L, at least about 20 g/L, at least about 30 g/L, at least about 50 g/L, at least about 75 g/L, at least about 100 g/L, at least about 150 g/L or at least about 200 g/L, or even greater. The values for substrate loadings provided herein are based on the molecular weight of compound (1b), however it also contemplated that the equivalent molar amounts of other ketone and amine substrates, such as ketone substrate compounds (1a)-(10, and amine substrate compounds (2a)-(21), could be used, as well as equimolar amounts of hydrates or salts of any of these compounds can be used in the process. It is also contemplated that in some embodiments, the suitable reaction conditions comprise loading of each of the ketone and amine substrate compounds in terms of molar concentrations equivalent to the above g/L concentrations for compound (1b). Thus, reaction conditions can comprise a substrate loading of each of the ketone and amine substrate compounds of at least about 5 mM, at least about 10 mM, at least about 25 mM, at least about 50 mM, at least about 75 mM, at least about 100 mM, or even greater. In addition, it is contemplated that substrate compounds covered by formulas (I) and (II), can be used in the same ranges of amounts as those used for compound (1b).

In carrying out the imine reductase mediated processes described herein, the engineered polypeptide may be added to the reaction mixture in the form of a purified enzyme, partially purified enzyme, whole cells transformed with gene(s) encoding the enzyme, as cell extracts and/or lysates of such cells, and/or as an enzyme immobilized on a solid support. Whole cells transformed with gene(s) encoding the engineered imine reductase enzyme or cell extracts, lysates thereof, and isolated enzymes may be employed in a variety of different forms, including solid (e.g., lyophilized, spray-dried, and the like) or semisolid (e.g., a crude paste). The cell extracts or cell lysates may be partially purified by precipitation (ammonium sulfate, polyethyleneimine, heat treatment or the like, followed by a desalting procedure prior to lyophilization (e.g., ultrafiltration, dialysis, and the like). Any of the enzyme preparations (including whole cell preparations) may be stabilized by cross-linking using known cross-linking agents, such as, for example, glutaraldehyde or immobilization to a solid phase (e.g., Eupergit C, and the like).

The gene(s) encoding the engineered imine reductase polypeptides can be transformed into host cell separately or together into the same host cell. For example, in some embodiments one set of host cells can be transformed with gene(s) encoding one engineered imine reductase polypeptide and another set can be transformed with gene(s) encoding another engineered imine reductase polypeptide. Both sets of transformed cells can be utilized together in the reaction mixture in the form of whole cells, or in the form of lysates or extracts derived therefrom. In other embodiments, a host cell can be transformed with gene(s) encoding multiple engineered imine reductase polypeptide. In some embodiments the engineered polypeptides can be expressed in the form of secreted polypeptides and the culture medium containing the secreted polypeptides can be used for the imine reductase reaction.

The improved activity and/or stereoselectivity of the engineered imine reductase polypeptides disclosed herein provides for processes wherein higher percentage conversion can be achieved with lower concentrations of the engineered polypeptide. In some embodiments of the process, the suitable reaction conditions comprise an engineered polypeptide amount of about 1% (w/w), 2% (w/w), 5% (w/w), 10% (w/w), 20% (w/w), 30% (w/w), 40% (w/w), 50% (w/w), 75% (w/w), 100% (w/w) or more of substrate compound loading.

In some embodiments, the engineered polypeptides are present at about 0.01 g/L to about 50 g/L; about 0.05 g/L to about 50 g/L; about 0.1 g/L to about 40 g/L; about 1 g/L to about 40 g/L; about 2 g/L to about 40 g/L; about 5 g/L to about 40 g/L; about 5 g/L to about 30 g/L; about 0.1 g/L to about 10 g/L; about 0.5 g/L to about 10 g/L; about 1 g/L to about 10 g/L; about 0.1 g/L to about 5 g/L; about 0.5 g/L to about 5 g/L; or about 0.1 g/L to about 2 g/L. In some embodiments, the imine reductase polypeptide is present at about 0.01 g/L, 0.05 g/L, 0.1 g/L, 0.2 g/L, 0.5 g/L, 1, 2 g/L, 5 g/L, 10 g/L, 15 g/L, 20 g/L, 25 g/L, 30 g/L, 35 g/L, 40 g/L, or 50 g/L.

During the course of the reactions, the pH of the reaction mixture may change. The pH of the reaction mixture may be maintained at a desired pH or within a desired pH range. This may be done by the addition of an acid or a base, before and/or during the course of the reaction. Alternatively, the pH may be controlled by using a buffer. Accordingly, in some embodiments, the reaction condition comprises a buffer. Suitable buffers to maintain desired pH ranges are known in the art and include, by way of example and not limitation, borate, phosphate, 2-(N-morpholino)ethanesulfonic acid (MES), 3-(N-morpholino)propanesulfonic acid (MOPS), acetate, triethanolamine, and 2-amino-2-hydroxymethyl-propane-1,3-diol (Tris), and the like. In some embodiments, the buffer is phosphate. In some embodiments of the process, the suitable reaction conditions comprise a buffer (e.g., phosphate) concentration is from about 0.01 to about 0.4 M, 0.05 to about 0.4 M, 0.1 to about 0.3 M, or about 0.1 to about 0.2 M. In some embodiments, the reaction condition comprises a buffer (e.g., phosphate) concentration of about 0.01, 0.02, 0.03, 0.04, 0.05, 0.07, 0.1, 0.12, 0.14, 0.16, 0.18, 0.2, 0.3, or 0.4 M. In some embodiments, the reaction conditions comprise water as a suitable solvent with no buffer present.

In the embodiments of the process, the reaction conditions can comprise a suitable pH. The desired pH or desired pH range can be maintained by use of an acid or base, an appropriate buffer, or a combination of buffering and acid or base addition. The pH of the reaction mixture can be controlled before and/or during the course of the reaction. In some embodiments, the suitable reaction conditions comprise a solution pH from about 4 to about 10, pH from about 5 to about 10, pH from about 7 to about 11, pH from about 8 to about 10, pH from about 6 to about 8. In some embodiments, the reaction conditions comprise a solution pH of about 4, 4.5, 5, 5.5, 6, 6.5, 7, 7.5, 8, 8.5, 9, 9.5, or 10.

In the embodiments of the processes herein, a suitable temperature can be used for the reaction conditions, for example, taking into consideration the increase in reaction rate at higher temperatures, and the activity of the enzyme during the reaction time period. Accordingly, in some embodiments, the suitable reaction conditions comprise a temperature of from about 10° C. to about 80° C., about 10° C. to about 70° C., about 15° C. to about 65° C., about 20° C. to about 60° C., about 20° C. to about 55° C., about 25° C. to about 55° C., or about 30° C. to about 50° C. In some embodiments, the suitable reaction conditions comprise a temperature of about 10° C., 15° C., 20° C., 25° C., 30° C., 35° C., 40° C., 45° C., 50° C., 55° C., 60° C., 65° C., 70° C., 75° C., or 80° C. In some embodiments, the temperature during the enzymatic reaction can be maintained at a specific temperature throughout the course of the reaction. In some embodiments, the temperature during the enzymatic reaction can be adjusted over a temperature profile during the course of the reaction.

The processes of the disclosure are generally carried out in a solvent. Suitable solvents include water, aqueous buffer solutions, organic solvents, polymeric solvents, and/or co-solvent systems, which generally comprise aqueous solvents, organic solvents and/or polymeric solvents. The aqueous solvent (water or aqueous co-solvent system) may be pH-buffered or unbuffered. In some embodiments, the processes using the engineered imine reductase polypeptides can be carried out in an aqueous co-solvent system comprising an organic solvent (e.g., ethanol, isopropanol (IPA), dimethyl sulfoxide (DMSO), dimethylformamide (DMF), dimethylacetamide (DMAc), N-methyl-pyrrolidone (NMP), ethyl acetate, butyl acetate, 1-octanol, heptane, octane, methyl t butyl ether (MTBE), toluene, and the like), ionic or polar solvents (e.g., 1-ethyl-4-methylimidazolium tetrafluoroborate, 1-butyl-3-methylimidazolium tetrafluoroborate, 1-butyl-3-methylimidazolium hexafluorophosphate, glycerol, polyethylene glycol (PEG), and the like). In some embodiments, the co-solvent can be a polar solvent, such as a polyol, dimethylsulfoxide (DMSO), or lower alcohol. The non-aqueous co-solvent component of an aqueous co-solvent system may be miscible with the aqueous component, providing a single liquid phase, or may be partly miscible or immiscible with the aqueous component, providing two liquid phases. Exemplary aqueous co-solvent systems can comprise water and one or more co-solvents selected from an organic solvent, polar solvent, and polyol solvent. In general, the co-solvent component of an aqueous co-solvent system is chosen such that it does not adversely inactivate the imine reductase enzyme under the reaction conditions. Appropriate co-solvent systems can be readily identified by measuring the enzymatic activity of the specified engineered imine reductase enzyme with a defined substrate of interest in the candidate solvent system, utilizing an enzyme activity assay, such as those described herein.

In some embodiments of the process, the suitable reaction conditions comprise an aqueous co-solvent, where the co-solvent comprises DMSO at about 1% to about 50% (v/v), about 1 to about 40% (v/v), about 2% to about 40% (v/v), about 5% to about 30% (v/v), about 10% to about 30% (v/v), or about 10% to about 20% (v/v). In some embodiments of the process, the suitable reaction conditions can comprise an aqueous co-solvent comprising DMSO at about 1% (v/v), about 5% (v/v), about 10% (v/v), about 15% (v/v), about 20% (v/v), about 25% (v/v), about 30% (v/v), about 35% (v/v), about 40% (v/v), about 45% (v/v), or about 50% (v/v).

In some embodiments, the reaction conditions can comprise a surfactant for stabilizing or enhancing the reaction. Surfactants can comprise non-ionic, cationic, anionic and/or amphiphilic surfactants. Exemplary surfactants, include by way of example and not limitations, nonyl phenoxypoly-ethoxylethanol (NP40), Triton X-100, polyoxyethylene-stearylamine, cetyltrimethylammonium bromide, sodium oleylamidosulfate, polyoxyethylene-sorbitanmonostearate, hexadecyldimethylamine, etc. Any surfactant that may stabilize or enhance the reaction may be employed. The concentration of the surfactant to be employed in the reaction may be generally from 0.1 to 50 mg/ml, particularly from 1 to 20 mg/ml.

In some embodiments, the reaction conditions can include an antifoam agent, which aid in reducing or preventing formation of foam in the reaction solution, such as when the reaction solutions are mixed or sparged. Anti-foam agents include non-polar oils (e.g., minerals, silicones, etc.), polar oils (e.g., fatty acids, alkyl amines, alkyl amides, alkyl sulfates, etc.), and hydrophobic (e.g., treated silica, polypropylene, etc.), some of which also function as surfactants. Exemplary anti-foam agents include, Y-30® (Dow Corning), polyglycol copolymers, oxy/ethoxylated alcohols, and polydimethylsiloxanes. In some embodiments, the anti-foam can be present at about 0.001% (v/v) to about 5% (v/v), about 0.01% (v/v) to about 5% (v/v), about 0.1% (v/v) to about 5% (v/v), or about 0.1% (v/v) to about 2% (v/v). In some embodiments, the anti-foam agent can be present at about 0.001% (v/v), about 0.01% (v/v), about 0.1% (v/v), about 0.5% (v/v), about 1% (v/v), about 2% (v/v), about 3% (v/v), about 4% (v/v), or about 5% (v/v) or more as desirable to promote the reaction.

The quantities of reactants used in the imine reductase reaction will generally vary depending on the quantities of product desired, and concomitantly the amount of imine reductase substrate employed. Those having ordinary skill in the art will readily understand how to vary these quantities to tailor them to the desired level of productivity and scale of production.

In some embodiments, the order of addition of reactants is not critical. The reactants may be added together at the same time to a solvent (e.g., monophasic solvent, biphasic aqueous co-solvent system, and the like), or alternatively, some of the reactants may be added separately, and some together at different time points. For example, the cofactor, co-substrate, imine reductase, and substrate may be added first to the solvent.

The solid reactants (e.g., enzyme, salts, etc.) may be provided to the reaction in a variety of different forms, including powder (e.g., lyophilized, spray dried, and the like), solution, emulsion, suspension, and the like. The reactants can be readily lyophilized or spray dried using methods and equipment that are known to those having ordinary skill in the art. For example, the protein solution can be frozen at −80° C. in small aliquots, then added to a pre-chilled lyophilization chamber, followed by the application of a vacuum.

For improved mixing efficiency when an aqueous co-solvent system is used, the imine reductase, and cofactor may be added and mixed into the aqueous phase first. The organic phase may then be added and mixed in, followed by addition of the imine reductase substrate and co-substrate. Alternatively, the imine reductase substrate may be premixed in the organic phase, prior to addition to the aqueous phase.

The imine reductase reaction is generally allowed to proceed until further conversion of substrates to product does not change significantly with reaction time, e.g., less than 10% of substrates being converted, or less than 5% of substrates being converted). In some embodiments, the reaction is allowed to proceed until there is complete or near complete conversion of substrates to product. Transformation of substrates to product can be monitored using known methods by detecting substrate and/or product, with or without derivatization. Suitable analytical methods include gas chromatography, HPLC, and the like.

In some embodiments of the process, the suitable reaction conditions comprise a loading of substrates of at least about 5 g/L, 10 g/L, 20 g/L, 30 g/L, 40 g/L, 50 g/L, 60 g/L, 70 g/L, 100 g/L, or more, and wherein the method results in at least about 50%, 60%, 70%, 80%, 90%, 95% or greater conversion of substrate compounds to product compound in about 48 h or less, in about 36 h or less, or in about 24 h or less.

The engineered imine reductase polypeptides of the present disclosure when used in the process under suitable reaction conditions result in a diastereomeric excess of the desired secondary or tertiary amine product in at least 90%, 95%, 96%, 97%, 98%, 99%, or greater. In some embodiments, no detectable amount of the undesired diastereomeric secondary or tertiary amine product is formed.

In further embodiments of the processes for converting substrate compounds to amine product compound using the engineered imine reductase polypeptides, the suitable reaction conditions can comprise initial substrate loadings to the reaction solution which is then contacted by the polypeptide. This reaction solution is the further supplemented with additional substrate compounds as a continuous or batchwise addition over time at a rate of at least about 1 g/L/h, at least about 2 g/L/h, at least about 4 g/L/h, at least about 6 g/L/h, or higher. Thus, according to these suitable reaction conditions, polypeptide is added to a solution having initial ketone and amine substrate loadings of each at least about 20 g/L, 30 g/L, or 40 g/L. This addition of polypeptide is then followed by continuous addition of further ketone and amine substrates to the solution at a rate of about 2 g/L/h, 4 g/L/h, or 6 g/L/h until a much higher final substrate loading of each at least about 30 g/L, 40 g/L, 50 g/L, 60 g/L, 70 g/L, 100 g/L, 150 g/L, 200 g/L or more, is reached. Accordingly, in some embodiments of the process, the suitable reaction conditions comprise addition of the polypeptide to a solution having initial substrate loadings of each at least about 20 g/L, 30 g/L, or 40 g/L followed by addition of further ketone and amine substrates to the solution at a rate of about 2 g/L/h, 4 g/L/h, or 6 g/L/h until a final substrate loading of at least about 30 g/L, 40 g/L, 50 g/L, 60 g/L, 70 g/L, 100 g/L or more, is reached. These substrate supplementation reaction conditions allow for higher substrate loadings to be achieved while maintaining high rates of conversion of substrates to amine product of at least about 50%, 60%, 70%, 80%, 90% or greater conversion.

In some embodiments of the processes, the reaction using an engineered imine reductase polypeptide can comprise the following suitable reaction conditions: (a) substrate loading at about 5 g/L to 30 g/L; (b) about 0.1 g/L to 10 g/L of the engineered polypeptide; (c) about 19 g/L (0.13 M) to 57 g/L (0.39 M) of (1-ketoglutarate; (d) about 14 g/L (0.08 M) to 63 g/L (0.36 M) ascorbic acid; (e) about 1.5 g/L (3.8 mM) to 4.5 g/L (11.5 mM) of $FeSO_4$; (f) a pH of about 6 to 9; (g) temperature of about 20° to 50° C.; and (h) reaction time of 2-24 hrs.

In some embodiments of the processes, the reaction using an engineered imine reductase polypeptide can comprise the following suitable reaction conditions: (a) substrate loading at about 10 g/L to 100 g/L; (b) about 1 g/L to about 50 g/L of engineered polypeptide; (c) NADH or NADPH loading at about 0.1 g/L to about 5 g/L; (d) pH of about 6 to 10; (g) temperature of about 20° to 50° C.; and (h) reaction time of 6 to 120 hrs.

In some embodiments, additional reaction components or additional techniques carried out to supplement the reaction conditions. These can include taking measures to stabilize or prevent inactivation of the enzyme, reduce product inhibition, shift reaction equilibrium to amine product formation.

In further embodiments, any of the above described process for the conversion of substrate compound to product compound can further comprise one or more steps selected from: extraction; isolation; purification; and crystallization of product compound. Methods, techniques, and protocols for extracting, isolating, purifying, and/or crystallizing the amine product from biocatalytic reaction mixtures produced by the above disclosed methods are known to the ordinary artisan and/or accessed through routine experimentation. Additionally, illustrative methods are provided in the Examples below.

Various features and embodiments of the disclosure are illustrated in the following representative examples, which are intended to be illustrative, and not limiting.

7. EXAMPLES

Example 1

Synthesis, Optimization, and Screening Engineered Polypeptides Derived from CENDH Having Imine Reductase Activity Gene Synthesis and Optimization:

The polynucleotide sequence encoding the reported wild-type opine dehydrogenase polypeptide CENDH from *Arthrobacter* Sp. Strain C1, as represented by SEQ ID NO: 2, was codon-optimized using the GeneIOS synthesis platform (GeneOracle) and synthesized as the gene of SEQ ID NO: 1. The synthetic gene of SEQ ID NO: 1 was cloned into a pCK110900 vector system (see e.g., US Patent Application Publication 20060195947, which is hereby incorporated by reference herein) and subsequently expressed in *E. coli* W3110fhuA. The *E. coli* W3110 expressed the opine dehydrogenase polypeptide CENDH under the control of the lac promoter. Based on sequence comparisons with other CENDH (and other amino acid dehydrogenases) and computer modeling of the CENDH structure docked to the substrate, residue positions associated with the active site, peptide loops, solution/substrate interface, and potential stability positions were identified. Briefly, directed evolution of the CENDH gene was carried out by constructing libraries of variant genes in which these positions associated with certain structural features were subjected to mutagenesis. These libraries were then plated, grown-up, and screened using HTP assays as described in Examples 2 and 3 to provide a first round ("Round 1") of 41 engineered CENDH variant polypeptides with imine reductase activity having even numbered sequence identifiers SEQ ID NO: 4-86. These amino acid differences identified in these Round 1 variants were recombined to build new Round 2 libraries which were then screened for activity with the ketone substrate of compound (1b) and the amine substrate of compound (2b). This imine reductase activity screened for in Round 2 was not detectable in the naturally occurring opine dehydrogenase CENDH polypeptide from which the variants were derived. This second round of directed evolution resulted in the 7 engineered polypeptides having the even numbered sequence identifiers of SEQ ID NO: 88-100. These Round 2 variants of CENDH have from 4 to 10 amino acid differences relative to SEQ ID NO: 2 and have the non-natural imine reductase activity of reductively aminating cyclohexanone with butylamine to produce the secondary amine product compound (2d).

Example 2

Production of Engineered Polypeptides Derived from CENDH Having Imine Reductase Activity The engineered imine reductase polypeptides were produced in E. coli W3110 under the control of the lac promoter. Enzyme preparations for HTP and SFP assays were made as follows.

High-Throughput (HTP) Growth, Expression, and Lysate Preparation.

Cells were picked and grown overnight in LB media containing 1% glucose and 30 µg/mL chloramphenicol (CAM), 30° C., 200 rpm, 85% humidity. 20 µL of overnight growth were transferred to a deep well plate containing 380 µL TB growth media containing 30 µg/mL CAM, 1 mM IPTG, and incubated for ~18 h at 30° C., 200 rpm, 85% humidity. Cell cultures were centrifuged at 4000 rpm, 4° C. for 10 min., and the media discarded. Cell pellets thus obtained were stored at −80° C. and used to prepare lysate for HTP reactions as follows. Lysis buffer containing 1 g/L lysozyme and 1 g/L PMBS was prepared in 0.1 M phosphate buffer, pH 8.5 (or pH 10). Cell pellets in 96 well plates were lysed in 250 µL lysis buffer, with low-speed shaking for 1.5 h on a titre-plate shaker at room temperature. The plates then were centrifuged at 4000 rpm for 10 mins at 4° C. and the clear supernatant was used as the clear lysate in the HTP assay reaction.

Production of Shake Flask Powders (SFP):

A shake-flask procedure was used to generate engineered imine reductase polypeptide powders used in secondary screening assays or in the biocatalytic processes disclosed herein. Shake flask powder (SFP) provides a more purified preparation (e.g., up to 30% of total protein) of the engineered enzyme as compared to the cell lysate used in HTP assays and, among other things, allows for the use of more concentrated enzyme solutions. A single colony of E. coli containing a plasmid encoding an engineered polypeptide of interest is inoculated into 50 mL Luria Bertani broth containing 30 µg/ml chloramphenicol and 1% glucose. Cells are grown overnight (at least 16 hours) in an incubator at 30° C. with shaking at 250 rpm. The culture is diluted into 250 mL Terrific Broth (12 g/L bacto-tryptone, 24 g/L yeast extract, 4 mL/L glycerol, 65 mM potassium phosphate, pH 7.0, 1 mM $MgSO_4$) containing 30 µg/ml chloramphenicol, in a 1 L flask to an optical density of 600 nm ($OD_{600}$) of 0.2 and allowed to grow at 30° C. Expression of the imine reductase gene is induced by addition of isopropyl-β-D-thiogalactoside ("IPTG") to a final concentration of 1 mM when the $OD_{600}$ of the culture is 0.6 to 0.8. Incubation is then continued overnight (at least 16 hours). Cells are harvested by centrifugation (5000 rpm, 15 min, 4° C.) and the supernatant discarded. The cell pellet is resuspended with an equal volume of cold (4° C.) 50 mM potassium phosphate buffer, pH 7.5, and harvested by centrifugation as above. The washed cells are resuspended in two volumes of the cold 50 mM potassium phosphate buffer, pH 7.5 and passed through a French Press twice at 12,000 psi while maintained at 4° C. Cell debris is removed by centrifugation (10,000 rpm, 45 minutes, 4° C.). The clear lysate supernatant is collected and stored at −20° C. Lyophilization of frozen clear lysate provides a dry shake-flask powder of crude engineered polypeptide. Alternatively, the cell pellet (before or after washing) can be stored at 4° C. or −80° C.

Example 3

HTP and SFP Screening of Engineered Polypeptides Derived from CENDH for Improved Imine Reductase Activity with Various Ketone and Amine Substrate Compounds HTP Screening Assays of Round 1 Engineered Polypeptides:

High-throughput screening used to guide primary selection of variants was carried out in 96-well plates using clear cell lysate. The variants from the first round of CENDH (SEQ ID NO: 2) mutagenesis were screened using two different HTP assay reactions as noted in Table 3A: (1) the combination of ketone substrate compound (1a), pyruvate, and the amine substrate compound (2b), butylamine; and (2) the combination of ketone substrate (1b), cyclohexanone, and the amine substrate compound (2a), L-norvaline.

Secondary screening of Round 1 variants using SFP preparations:

SFP preparations were prepared for a selection of the Round 1 engineered polypeptides derived from CENDH exhibiting improved activity relative to the CENDH wild-type of SEQ ID NO: 2 in one or both of the HTP screening assays. These SFP preparations were submitted to a secondary screening with the three substrate combinations cyclohexanone/L-norvaline, cyclopentanone/L-norvaline, acetophenone/L-norvaline using the SFP assay as described in Table 3C.

HTP Screening Assays of Round 2 Engineered Polypeptides:

As described in Example 1, Round 2 libraries of engineered polypeptides were prepared by recombining beneficial amino acid differences identified in Round 1 with a "backbone" polypeptide sequence of either SEQ ID NO: 6 or 86, which had the N198H, and N198E amino difference. These Round 2 libraries were subjected to HTP screening in the cyclohexanone/butylamine assay as described in Table 3B. Seven engineered polypeptides were identified (SEQ ID NO: 88, 90, 92, 94, 96, 98, and 100) having the imine reductase activity of converting cyclohexanone and butylamine to the secondary amine product of compound (2d). This activity is not detectable in the naturally occurring opine dehydrogenase CENDH from which the polypeptides were derived. These Round 2 engineered polypeptides have from 4 to 10 amino acid differences relative to SEQ ID NO: 2.

Further Activity Screening of Round 2 Variants Using SFP Preparations:

SFP preparations were prepared for the seven Round 2 variants and these preparations were subjected several other activity assays using a range of ketone and amine substrate compounds as listed in Tables 3D and 3E.

Analysis of HTP and SFP Assay Reaction:

The combination method of Liquid Chromatography and Mass Spectrometry (LC-MS) was used as the primary analytical method to detect and quantify the various HTP and SFP assay reaction results of Tables 3A, 3B, 3C, 3D, and 3E. Details of the LC-MS analysis are provided below.

LC-MS Analysis (Tables 3A-3E):

After the HTP assay or SFP assay reaction mixtures were shaken overnight at high-speed on a titre-plate shaker at room temperature, each reaction mixture was quenched with $CH_3CN$ and diluted 10 fold in $CH_3CN/H_2O$/formic acid (50/50/0.1). The quenched and diluted reaction mixtures were analyzed by LC-MS in multiple reaction monitoring (MRM) mode. The relevant LC instrumental parameters and conditions were as shown below.

| | |
|---|---|
| LC Instrument | Agilent HPLC 1200 series, API 3200 Qtrap |
| Column | Poroshell EC C18 50 × 3.0 mm, 2.7 μm, attached with Agilent C18 guard column (narrow bore) |
| Mobile Phase | Gradient (A: 0.5 mM perfluoroheptanoic acid (PFHA); B: MeCN) |

| T (min) | B % |
|---|---|
| 0-1.5 | 3 |
| 9 | 30 |
| 12 | 30 |
| 13 | 3 |
| 20 | 3 |

| | |
|---|---|
| Flow Rate | 0.8 mL/min |
| Detection | Q1MS, positive, DP 25V, EP 10V, CUR 30, IS 5000, TEM 575° C., GS1 55, GS2 60. |
| Column Temperature | Not controlled |
| Injection Volume | 2 μL |
| Run time | 20 min |

The relevant MS parameters for the cyclohexanone/L-norvaline assay reaction were: [M+H]+: 200; Main fragment ions at CE=20 ev: 154, 118, 83, 72, 55. The MRM transitions used for monitoring product formation: 200/118; 200/72.

The relevant MS parameters for the pyruvate/butylamine assay reaction were: [M+H]+: 146; Main fragment ion at CE=20 ev: 100. MRM transitions used for monitoring product formation: 146/100.

The relevant MS parameters for the cyclohexanone/butylamine assay reaction were: [M+H]+: 156; Main fragment ions at CE=20 ev; 83, 74, 55. MRM transitions used for monitoring product formation: 156/83; 156/74; 156/55.

The relevant MS parameters for the cyclopentanone/L-norvaline assay reaction: [M+H]$^+$: 186; Main fragment ions at CE=20 ev; 140, 118, 79, 72. MRM transitions used for monitoring product formation: 186/72; 186/118; 186/69.

The relevant MS parameters for the acetophenone/L-norvaline assay reaction: [M+H]$^+$: 222; Main fragment ions at CE=20 ev; 118, 105, 72. MRM transitions used for monitoring product formation: 222/118; 222/105; 222/72.

The relevant MS parameters for the 2-methoxy cyclohexanone/butylamine assay reaction: [M+H]$^+$: 186; Main fragment ions at CE=20 ev; 154, 113, 98, 81. MRM transitions used for monitoring product formation: 186/154; 186/81.

The relevant MS parameters for the cyclohexanone/methylamine assay reaction: [M+H]$^+$: 114; Main fragment ions at CE=20 ev; 83, 55. MRM transitions used for monitoring product formation: 114/83; 114/55.

The relevant MS parameters for the cyclohexanone/aniline assay reaction: [M+H]$^+$: 176; Main fragment ions at CE=20 ev; 135, 94, 83, 55. MRM transitions used for monitoring product formation: 176/94.

The relevant MS parameters for the 2-pentanone/butylamine assay reaction: [M+H]$^+$: 144; Main fragment ions at CE=15 ev; 144, 114, 74, 71. MRM transitions used for monitoring product formation: 144/74; 144/71; 144/43.

The relevant MS parameters for the hydroxy acetone/dimethylamine assay reaction: [M+H]$^+$: 104; Main fragment ions at CE=25 ev; 86, 71, 59, 46, 41. MRM transitions used for monitoring product formation: 104/86; 104/46.

Example 4

HTP Screening of Engineered Polypeptides Derived from SEQ ID NO: 96 for Improved Stability and Imine Reductase Activity in Preparing Compounds (3n) and (3o)

The Round 2 engineered polypeptide having imine reductase activity of SEQ ID NO: 96 was used to generate further engineered polypeptides of Tables 3F-3J which have further improved stability (e.g., activity at 44° C.) and improved imine reductase activity (e.g., % conversion of ketone substrate compound (1j) to product). These engineered polypeptides, which have the amino acid sequences of even-numbered sequence identifiers SEQ ID NO: 112-750, were generated from the "backbone" amino acid sequence of SEQ ID NO: 96 using the directed evolution methods of Examples 1 and 2 together with HTP assay methods as noted in Tables 3F-3J. Further details of amine product LC-MS analysis of the assay mixtures is provided below.

LC-MS Analysis for Amine Product Compound (3n):

After the HTP assay mixtures were shaken overnight at 250 rpm on a titre-plate shaker at 35° C., each reaction mixture was quenched by adding 250 μL CH$_3$CN, shaken, and centrifuged at 4000 rpm and 4° C. for 10 min. 20 μL of the quenched mixture was diluted 10 fold in 180 μL CH$_3$CN/H$_2$O (50/50) with mixing. 10 μL of this 10-fold dilution mixture was then further diluted in 190 μL CH$_3$CN/H$_2$O (50/50) for a total 400 fold diluted mixtures. These mixtures were analyzed by LC-MS in MRM mode. Formation of the product compound (1i), N-butyl-5-methoxy-1,2,3,4-tetrahydronaphthalen-2-amine, using the MRM transition: 234/161. Additional relevant LC-MS instrumental parameters and conditions were as shown below.

| | |
|---|---|
| Instrument | Agilent HPLC 1200 series, API 3200 Qtrap |
| Column | Poroshell 120 EC C18 50 × 3.0 mm, 2.7 μm |
| Mobile Phase | Gradient (A: 0.1% formic acid in water; B: MeCN; A:B = 36:64) |
| Flow Rate | 0.8 mL/min |
| Run time | 0.7 min |
| Peak Retention Times | Compound (3n): 0.55 min |
| Column Temperature | 25° C. |
| Injection Volume | 2 μL |
| MS Detection | Qtrap3200; MRM234/161 (for N-butyl-5-methoxy-1,2,3,4-tetrahydronaphthalen-2-amine); 0-0.4 min bypass MS |
| MS Conditions | MODE: MRM; CUR: 30; IS: 5500; CAD: medium; TEM: 560° C.; GS1: 60; GS2: 60; DP: 30; EP: 9; CE: 25; CXP: 3; DT: 380 ms |

LC-MS Analysis for Amine Product Compound (3o):

After the HTP assay mixtures were shaken overnight at 250 rpm on a titre-plate shaker at 35° C., each reaction mixture was quenched with 100 μL CH$_3$CN, heat-sealed, shaken, and centrifuged at 4000 rpm, 4° C., for 10 min. 20 μL of the quenched mixture was diluted 10-fold in 180 μL CH$_3$CN/H$_2$O (50/50) with mixing. The 10-fold diluted reaction mixtures were analyzed by LC-MS in multiple reaction monitoring (MRM) mode. The relevant instrumental parameters and conditions were as shown below.

| | |
|---|---|
| Instrument | Agilent HPLC 1260 coupled with API 2000 Qtrap |
| Column | Poroshell 120 EC C18 50 × 3.0 mm, 2.7 μm (Agilent Technologies, Santa Clara, CA) |

-continued

| | |
|---|---|
| Mobile Phase | Gradient (A: 0.1% formic acid in water; B: MeCN) |
| Flow Rate | 0.8 mL/min |

| T (min) | B % |
|---|---|
| 0-0.8 | 25 |
| 2-2.5 | 90 |
| 2.6-3.5 | 30 |

| | |
|---|---|
| Run time | 3.5 min |
| Peak Retention Time | Compound (3o): 2.18 min |
| Column Temperature | 25° C. |
| Injection Volume | 10 µL |
| MS Detection | Compound (3o) detected in Qtrap2000 MRM mode: parent ion at m/z 336.25, fragment ion at m/z 154 |
| MS Conditions | CUR: 30; IS: 4500; CAD: 6; TEM: 550° C.; GS1: 60; GS2: 60; DP: 31; EP: 10; CE: 30; CXP: 3 |

All publications, patents, patent applications and other documents cited in this application are hereby incorporated by reference in their entireties for all purposes to the same extent as if each individual publication, patent, patent application or other document were individually indicated to be incorporated by reference for all purposes.

While various specific embodiments have been illustrated and described, it will be appreciated that various changes can be made without departing from the spirit and scope of the invention(s).

to product compound (3b), N-2-(butylamino)propanoic acid,

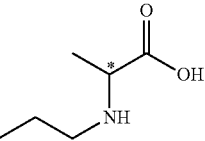
(3b)

under suitable reaction conditions.

3. The engineered polypeptide of claim 1 which is capable of converting substrate compound (1b) cyclohexanone,

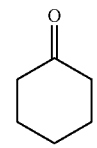
(1b)

and substrate compound (2a) L-norvaline

SEQUENCE LISTING (750 sequences)

SEQ ID NO: 1 - DNA, 1077 bp, Artificial Sequence
  Codon optimized opine dehydrogenase from Arthrobacter sp. strain 1C [CENDH]
atgatcgagtcaaaaacatacgccgttttgggattaggaaacgggggtcacgcatttgccgcctatttagcattgaagggccagagtgtactggcttgggacatcgatgctcagagaatcaaagagattcaggaccgtggagccatcatagcggaaggaccaggacttgctgggactgctcacccggatcttctgacctcagatataggtttggcggttaaagacgctgatgtgatactgattgtagtgccggccatccaccacgcttccattgcagcaaatatcgccagttacatttccgagggtcagttgattatccttaaccctggggcaacgggtggagcgctggaattccggaaaatcctgcgtgaaaatggtgcgccggaggtaacgatcggggaaacctcaagtatgctctttacatgccgctccgagagaccaggacaggttacggtaaatgcgataaaaggcgccatggactttgcatgtctcccagcggcaaaagctggatgggccctggaacagatagggtcggttcttcctcaatacgtggctgtcgaaaacgtgttgcatacttcgctgactaatgtgaacgctgtaatgcacccgctgccaacactgttaaacgctgctcgttgtgagtctggtaccccattccaatattatctggaggggattacgccatcagtcgggagtcttgcggagaaagtggacgctgaacgcatagcaatcgcaaaggctttcgatttaaacgttccgtcggtctgcgaatggtacaaggaaagttacggccagtcaccggccacaatttatgaagcggtgcagggtaatcctgcttatcgcggcattgcgggacctattaaccttaacacgcgctacttcttcgaggatgtaagcaccggactggtaccgttatccgaactgggtcgggcagtgaatgtgcctaccccacttatcgatgctgttcttgacttgatcagttcgctgatagacacggatttcagaaaggaaggtcgtaccttggaaaaattaggtctgagcggacttaccgccgcgggcataagaagtgctgttgag

SEQ ID NO: 2 - protein, 359 aa, Arthrobacter sp. strain 1C
MIESKTYAVLGLGNGGHAFAAYLALKGQSVLAWDIDAQRIKEIQDRGAIIAEGPGLAGTAHPDLLTSDIGLAVKDADVILIVVPAIHHASIAANIASYISEGQLIILNPGATGGALEFRKILRENGAPEVTIGETSSMLFTCRSERPGQVTVNAIKGAMDFACLPAAKAGWALEQIGSVLPQYVAVENVLHTSLTNVNAVMHPLPTLLNAARCESGTPFQYYLEGITPSVGSLAEKVDAERIAIAKAFDLNVPSVCEWYKESYGQSPATIYEAVQGNPAYRGIAGPINLNTRYFFEDVSTGLVPLSELGRAVNVPTPLIDAVLDLISSLIDTDFRKEGRTLEKLGLSGLTAAGIRSAVE

SEQ ID NO: 3 - DNA, 1077 bp, Artificial Sequence
  Engineered variant of opine dehydrogenase CENDH
atgatcgagtcaaaaacatacgccgttttgggattaggaaacgggggtcacgcatttgccgcctatttagcattgaagggccagagtgtactggcttgggacatcgatgctcagagaatcaaagagattcaggaccgtggagccatcatagcggaaggaccaggacttgctgggactgctcacccggatcttctgacctcagatataggtttggcggttaaagacgctgatgtgatactgattgtagtgccggccatccaccacgcttccattgcagcaaatatcgccagttacatttccgagggtcagttgattatccttaaccctggggcaacgggtggagcgctggaattccggaaaatcctgcgtgaaaatggtgcgccggaggtaacgatcggggaaacctcaagtatgctctttacatgccgctccgagagaccaggacaggttacggtaaatgcgataaaaggcgccatggactttgcatgtctcccagcggcaaaagctggatgggccctggaacagatagggtcggttcttcctcaatacgtggctgtcgaaaacgtgttgcatacttcgctgactaatgtggcggctgtaatgcacccgctgccaacactgttaaacgctgctcgttgtgagtctggtaccccattccaatattatctggaggggattacgccatcagtcgggagtcttgcggagaaagtggacgctgaacgcatagcaatcgcaaaggctttcgatttaaacgttccgtcggtctgcgaatggtacaaggaaagttacggccagtcaccggccacaatttatgaagcggtgcagggtaatcctgcttatcgcggcattgcgggacctattaaccttaacacgcgctacttcttcgaggatgtaagcaccggactggtaccgttatccgaactgggtcgggcagtgaatgtgcctaccccacttatcgatgctgttcttgacttgatcagttcgctgatagacacggatttcagaaaggaaggtcgtaccttggaaaaattaggtctgagcggacttaccgccgcgggcataagaagtgctgttgag

SEQ ID NO: 4 - protein, 359 aa, Artificial Sequence
  Engineered variant of opine dehydrogenase CENDH
MIESKTYAVLGLGNGGHAFAAYLALKGQSVLAWDIDAQRIKEIQDRGAIIAEGPGLAGTAHPDLLTSDIGLAVKDADVILIVVPAIHHASIAANIASYISEGQLIILNPGATGGALEFRKILRENGAPEVTIGETSSMLFTCRSERPGQVTVNAIKGAMDFACLPAAKAGWALEQIGSVLPQYVAVENVLHTSLTNVAAVMHPLPTLLNAARCESGTPFQYYLEGITPSVGSLAEKVDAERIAIAKAFDLNVPSVCEWYKESYGQSPATIYEAVQGNPAYRGIAGPINLNTRYFFEDVSTGLVPLSELGRAVNVPTPLIDAVLDLISSLIDTDFRKEGRTLEKLGLSGLTAAGIRSAVE

SEQ ID NO: 5 - DNA, 1077 bp, Artificial Sequence
  Engineered variant of opine dehydrogenase CENDH
atgatcgagtcaaaaacatacgccgttttgggattaggaaacgggggtcacgcatttgccgcctatttagcattgaagggccagagtgtactggcttgggacatcgatgctcagagaatcaaagagattcaggaccgtggagccatcatagcggaaggaccaggacttgctgggactgctcacccggatcttctgacctcagatataggtttggcggttaaagacgctgatgtgatactgattgtagtgccggccatccaccacgcttccattgcagcaaatatcgccagttacatttccgagggtcagttgattatccttaaccctggggcaacgggtggagcgctggaattccggaaaatcctgcgtgaaaatggtgcgccggaggtaacgatcggggaaacctcaagtatgctctttacatgccgctccgagagaccaggacaggttacggtaaatgcgataaaaggcgccatggactttgcatgtctcccagcggcaaaagctggatgggccctggaacagatagggtcggttcttcctcaatacgtggctgtcgaaaacgtgttgcatacttcgctgactaatgtgcatgctgtaatgcacccgctgccaacactgttaaacgctgctcgttgtgagtctggtaccccattccaatattatctggaggggattacgccatcagtcgggagtcttgcggagaaagtggacgctgaacgcatagcaatcgcaaaggctttcgatttaaacgttccgtcggtctgcgaatggtacaaggaaagttacggccagtcaccggccacaatttatgaagcggtgcagggtaatcctgcttatcgcggcattgcgggacctattaaccttaacacgcgctacttcttcgaggatgtaagcaccggactggtaccgttatccgaactgggtcgggcagtgaatgtgcctaccccacttatcgatgctgttcttgacttgatcagttcgctgatagacacggatttcagaaaggaaggtcgtaccttggaaaaattaggtctgagcggacttaccgccgcgggcataagaagtgctgttgag

SEQ ID NO: 6 - protein, 359 aa, Artificial Sequence
  Engineered variant of opine dehydrogenase CENDH
MIESKTYAVLGLGNGGHAFAAYLALKGQSVLAWDIDAQRIKEIQDRGAIIAEGPGLAGTAHPDLLTSDIGLAVKDADVILIVVPAIHHASIAANIASYISEGQLIILNPGATGGALEFRKILRENGAPEVTIGETSSMLFTCRSERPGQVTVNAIKGAMDFACLPAAKAGWALEQIGSVLPQYVAVENVLHTSLTNVHAVMHPLPTLLNAARCESGTPFQYYLEGITPSVGSLAEKVDAERIAIAKAFDLNVPSVCEWYKESYGQSPATIYEAVQGNPAYRGIAGPINLNTRYFFEDVSTGLVPLSELGRAVNVPTPLIDAVLDLISSLIDTDFRKEGRTLEKLGLSGLTAAGIRSAVE

SEQ ID NO: 7 - DNA, 1077 bp, Artificial Sequence
  Engineered variant of opine dehydrogenase CENDH
atgatcgagtcaaaaacatacgccgttttgggattaggaaacgggggtcacgcatttgccgcctatttagcattgaagggccagagtgtactggcttgggacatcgatgctcagagaatcaaagagattcaggaccgtggagccatcatagcggaaggaccaggacttgctgggactgctcacccggatcttctgacctcagatataggtttggcggttaaagacgctgatgtgatactgattgtagtgccggccatccaccacgcttccattgcagcaaatatcgccagttacatttccgagggtcagttgattatccttaaccctggggcaacgggtggagcgctggaattccggaaaatcctgcgtgaaaatggtgcgccggaggtaacgatcggggaaacctcaagtatgctctttacatgccgctccgagagaccaggacaggttacggtaaatgcgataattggcgccatggactttgcatgtctcccagcggcaaaagctggatgggccctggaacagatagggtcggttcttcctcaatacgtggctgtcgaaaacgtgttgcatacttcgctgactaatgtgaacgctgtaatgcacccgctgccaacactgttaaacgctgctcgttgtgagtctggtaccccattccaatattatctggaggggattacgccatcagtcgggagtcttgcggagaaagtggacgctgaacgcatagcaatcgcaaaggctttcgatttaaacgttccgtcggtctgcgaatggtacaaggaaagttacggccagtcaccggccacaatttatgaagcggtgcagggtaatcctgcttatcgcggcattgcgggacctattaaccttaacacgcgctacttcttcgaggatgtaagcaccggactggtaccgttatccgaactgggtcgggcagtgaatgtgcctaccccacttatcgatgctgttcttgacttgatcagttcgctgatagacacggatttcagaaaggaaggtcgtaccttggaaaaattaggtctgagcggacttaccgccgcgggcataagaagtgctgttgag

SEQ ID NO: 8 - protein, 359 aa, Artificial Sequence
  Engineered variant of opine dehydrogenase CENDH
MIESKTYAVLGLGNGGHAFAAYLALKGQSVLAWDIDAQRIKEIQDRGAIIAEGPGLAGTAHPDLLTSDIGLAVKDADVILIVVPAIHHASIAANIASYISEGQLIILNPGATGGALEFRKILRENGAPEVTIGETSSMLFTCRSERPGQVTVNAIIGAMDFACLPAAKAGWALEQIGSVLPQYVAVENVLHTSLTNVNAVMHPLPTLLNAARCESGTPFQYYLEGITPSVGSLAEKVDAERIAIAKAFDLNVPSVCEWYKESYGQSPATIYEAVQGNPAYRGIAGPINLNTRYFFEDVSTGLVPLSELGRAVNVPTPLIDAVLDLISSLIDTDFRKEGRTLEKLGLSGLTAAGIRSAVE

SEQ ID NO: 9 - DNA, 1077 bp, Artificial Sequence
  Engineered variant of opine dehydrogenase CENDH
atgatcgagtcaaaaacatacgccgttttgggattaggaaacgggggtcacgcatttgccgcctatttagcattgaagggccagagtgtactggcttgggacatcgatgctcagagaatcaaagagattcaggaccgtggagccatcatagcggaaggaccaggacttgctgggactgctcacccggatcttctgacctcagatataggtttggcggttaaagacgctgatgtgatactgattgtagtgccggccatccaccacgcttccattgcagcaaatatcgccagttacatttccgagggtcagttgattatccttaaccctggggcaacgggtggagcgctggaattccggaaaatcctgcgtgaaaatggtgcgccggaggtaacgatcggggaaacctcaagtatgctctttacatgccgctccgagagaccaggacaggttacggtaaatgcgataaaaggcgccatggactttgcatgtctcccagcggcaaaagctggatgggccctggaacagatagggtcggttcttcctcaatacgtggctgtcgaaaacgtgttgcatacttcgctgactaatattaacgctgtaatgcacccgctgccaacactgttaaacgctgctcgttgtgagtctggtaccccattccaatattatctggaggggattacgccatcagtcgggagtcttgcggagaaagtggacgctgaacgcatagcaatcgcaaaggctttcgatttaaacgttccgtcggtctgcgaatggtacaaggaaagttacggccagtcaccggccacaatttatgaagcggtgcagggtaatcctgcttatcgcggcattgcgggacctattaaccttaacacgcgctacttcttcgaggatgtaagcaccggactggtaccgttatccgaactgggtcgggcagtgaatgtgcctaccccacttatcgatgctgttcttgacttgatcagttcgctgatagacacggatttcagaaaggaaggtcgtaccttggaaaaattaggtctgagcggacttaccgccgcgggcataagaagtgctgttgag

SEQ ID NO: 10 - protein, 359 aa, Artificial Sequence
  Engineered variant of opine dehydrogenase CENDH
MIESKTYAVLGLGNGGHAFAAYLALKGQSVLAWDIDAQRIKEIQDRGAIIAEGPGLAGTAHPDLLTSDIGLAVKDADVILIVVPAIHHASIAANIASYISEGQLIILNPGATGGALEFRKILRENGAPEVTIGETSSMLFTCRSERPGQVTVNAIKGAMDFACLPAAKAGWALEQIGSVLPQYVAVENVLHTSLTNINAVMHPLPTLLNAARCESGTPFQYYLEGITPSVGSLAEKVDAERIAIAKAFDLNVPSVCEWYKESYGQSPATIYEAVQGNPAYRGIAGPINLNTRYFFEDVSTGLVPLSELGRAVNVPTPLIDAVLDLISSLIDTDFRKEGRTLEKLGLSGLTAAGIRSAVE

SEQ ID NO: 11 - DNA, 1077 bp, Artificial Sequence
  Engineered variant of opine dehydrogenase CENDH
atgatcgagtcaaaaacatacgccgttttgggattaggaaacgggggtcacgcatttgccgcctatttagcattgaagggccagagtgtactggcttgggacatcgatgctcagagaatcaaagagattcaggaccgtggagccatcatagcggaaggaccaggacttgctgggactgctcacccggatcttctgacctcagatataggtttggcggttaaagacgctgatgtgatactgattgtagtgccggccatccaccacgcttccattgcagcaaatatcgccagttacatttccgagggtcagttgattatccttaaccctggggcaacgggtggagcgctggaattccggaaaatcctgcgtgaaaatggtgcgccggaggtaacgatcggggaaacctcaagtatgctctttacatgccgctccgagagaccaggacaggttacggtaaatgcgatagttggcgccatggactttgcatgtctcccagcggcaaaagctggatgggccctggaacagatagggtcggttcttcctcaatacgtggctgtcgaaaacgtgttgcatacttcgctgactaatgtgaacgctgtaatgcacccgctgccaacactgttaaacgctgctcgttgtgagtctggtaccccattccaatattatctggaggggattacgccatcagtcgggagtcttgcggagaaagtggacgctgaacgcatagcaatcgcaaaggctttcgatttaaacgttccgtcggtctgcgaatggtacaaggaaagttacggccagtcaccggccacaatttatgaagcggtgcagggtaatcctgcttatcgcggcattgcgggacctattaaccttaacacgcgctacttcttcgaggatgtaagcaccggactggtaccgttatccgaactgggtcgggcagtgaatgtgcctaccccacttatcgatgctgttcttgacttgatcagttcgctgatagacacggatttcagaaaggaaggtcgtaccttggaaaaattaggtctgagcggacttaccgccgcgggcataagaagtgctgttgag

SEQ ID NO: 12 - protein, 359 aa, Artificial Sequence
  Engineered variant of opine dehydrogenase CENDH
MIESKTYAVLGLGNGGHAFAAYLALKGQSVLAWDIDAQRIKEIQDRGAIIAEGPGLAGTAHPDLLTSDIGLAVKDADVILIVVPAIHHASIAANIASYISEGQLIILNPGATGGALEFRKILRENGAPEVTIGETSSMLFTCRSERPGQVTVNAIVGAMDFACLPAAKAGWALEQIGSVLPQYVAVENVLHTSLTNVNAVMHPLPTLLNAARCESGTPFQYYLEGITPSVGSLAEKVDAERIAIAKAFDLNVPSVCEWYKESYGQSPATIYEAVQGNPAYRGIAGPINLNTRYFFEDVSTGLVPLSELGRAVNVPTPLIDAVLDLISSLIDTDFRKEGRTLEKLGLSGLTAAGIRSAVE

SEQ ID NO: 13 - DNA, 1077 bp, Artificial Sequence
  Engineered variant of opine dehydrogenase CENDH
atgatcgagtcaaaaacatacgccgttttgggattaggaaacgggggtcacgcatttgccgcctatttagcattgaagggccagagtgtactggcttgggacatcgatgctcagagaatcaaagagattcaggaccgtggagccatcatagcggaaggaccaggacttgctgggactgctcacccggatcttctgacctcagatataggtttggcggttaaagacgctgatgtgatactgattgtagtgccggccatccaccacgcttccattgcagcaaatatcgccagttacatttccgagggtcagttgattatccttaaccctggggcaacgggtggagcgctggaattccggaaaatcctgcgtgaaaatggtgcgccggaggtaacgatcggggaaacctcaagtatgctctttacatgccgctccgagagaccaggacaggttacggtaaatgcgataaaaggcgccatggactttgcatgtctcccagcggcaaaagctggatgggccctggaacagatagggtcggttcttcctcaatacgtggctgtcgaaaacgtgttgcatacttcgctgactaatgtgaacgctgtaatgcacccgctgccaacactgttaaacgctgctcgttgtgagtctggtaccccattccaatattatctggaggggattacgccatcagtcgggagtcttgcggagaaagtggacgctgaacgcatagcaatcgcaaaggctttcgatttaaacgttccgtcggtctgcgaatggacgaaggaaagttacggccagtcaccggccacaatttatgaagcggtgcagggtaatcctgcttatcgcggcattgcgggacctattaaccttaacacgcgctacttcttcgaggatgtaagcaccggactggtaccgttatccgaactgggtcgggcagtgaatgtgcctaccccacttatcgatgctgttcttgacttgatcagttcgctgatagacacggatttcagaaaggaaggtcgtaccttggaaaaattaggtctgagcggacttaccgccgcgggcataagaagtgctgttgag

SEQ ID NO: 14 - protein, 359 aa, Artificial Sequence
  Engineered variant of opine dehydrogenase CENDH
MIESKTYAVLGLGNGGHAFAAYLALKGQSVLAWDIDAQRIKEIQDRGAIIAEGPGLAGTAHPDLLTSDIGLAVKDADVILIVVPAIHHASIAANIASYISEGQLIILNPGATGGALEFRKILRENGAPEVTIGETSSMLFTCRSERPGQVTVNAIKGAMDFACLPAAKAGWALEQIGSVLPQYVAVENVLHTSLTNVNAVMHPLPTLLNAARCESGTPFQYYLEGITPSVGSLAEKVDAERIAIAKAFDLNVPSVCEWTKESYGQSPATIYEAVQGNPAYRGIAGPINLNTRYFFEDVSTGLVPLSELGRAVNVPTPLIDAVLDLISSLIDTDFRKEGRTLEKLGLSGLTAAGIRSAVE

SEQ ID NO: 15 - DNA, 1077 bp, Artificial Sequence
  Engineered variant of opine dehydrogenase CENDH
atgatcgagtcaaaaacatacgccgttttgggattaggaaacgggggtcacgcatttgccgcctatttagcattgaagggccagagtgtactggcttgggacatcgatgctcagagaatcaaagagattcaggaccgtggagccatcatagcggaaggaccaggacttgctgggactgctcacccggatcttctgacctcagatataggtttggcggttaaagacgctgatgtgatactgattgtagtgccggccatccaccacgcttccattgcagcaaatatcgccagttacatttccgagggtcagttgattatccttaaccctggggcaacgggtggagcgctggaattccggaaaatcctgcgtgaaaatggtgcgccggaggtaacgatcggggaaacctcaagtatgctctttacatgccgctccgagagaccaggacaggttacggtaaatgcgataaaaggcgccatggactttgcatgtctcccagcggcaaaagctggatgggccctggaacagatagggtcggttcttcctcaatacgtggctgtcgaaaacgtgttgcatacttcgctgactaatgtgcctgctgtaatgcacccgctgccaacactgttaaacgctgctcgttgtgagtctggtaccccattccaatattatctggaggggattacgccatcagtcgggagtcttgcggagaaagtggacgctgaacgcatagcaatcgcaaaggctttcgatttaaacgttccgtcggtctgcgaatggtacaaggaaagttacggccagtcaccggccacaatttatgaagcggtgcagggtaatcctgcttatcgcggcattgcgggacctattaaccttaacacgcgctacttcttcgaggatgtaagcaccggactggtaccgttatccgaactgggtcgggcagtgaatgtgcctaccccacttatcgatgctgttcttgacttgatcagttcgctgatagacacggatttcagaaaggaaggtcgtaccttggaaaaattaggtctgagcggacttaccgccgcgggcataagaagtgctgttgag

SEQ ID NO: 16 - protein, 359 aa, Artificial Sequence
  Engineered variant of opine dehydrogenase CENDH
MIESKTYAVLGLGNGGHAFAAYLALKGQSVLAWDIDAQRIKEIQDRGAIIAEGPGLAGTAHPDLLTSDIGLAVKDADVILIVVPAIHHASIAANIASYISEGQLIILNPGATGGALEFRKILRENGAPEVTIGETSSMLFTCRSERPGQVTVNAIKGAMDFACLPAAKAGWALEQIGSVLPQYVAVENVLHTSLTNVPAVMHPLPTLLNAARCESGTPFQYYLEGITPSVGSLAEKVDAERIAIAKAFDLNVPSVCEWYKESYGQSPATIYEAVQGNPAYRGIAGPINLNTRYFFEDVSTGLVPLSELGRAVNVPTPLIDAVLDLISSLIDTDFRKEGRTLEKLGLSGLTAAGIRSAVE

SEQ ID NO: 17 - DNA, 1077 bp, Artificial Sequence
  Engineered variant of opine dehydrogenase CENDH
atgatcgagtcaaaaacatacgccgttttgggattaggaaacgggggtcacgcatttgccgcctatttagcattgaagggccagagtgtactggcttgggacatcgatgctcagagaatcaaagagattcaggaccgtggagccatcatagcggaaggaccaggacttgctgggactgctcacccggatcttctgacctcagatataggtttggcggttaaagacgctgatgtgatactgattgtagtgccggccatccaccacgcttccattgcagcaaatatcgccagttacatttccgagggtcagttgattatccttaaccctggggcaacgggtggagcgctggaattccggaaaatcctgcgtgaaaatggtgcgccggaggtaacgatcggggaaacctcaagtatgctctttacatgccgctccgagagaccaggacaggttacggtaaatgcgataacgggcgccatggactttgcatgtctcccagcggcaaaagctggatgggccctggaacagatagggtcggttcttcctcaatacgtggctgtcgaaaacgtgttgcatacttcgctgactaatgtgaacgctgtaatgcacccgctgccaacactgttaaacgctgctcgttgtgagtctggtaccccattccaatattatctggaggggattacgccatcagtcgggagtcttgcggagaaagtggacgctgaacgcatagcaatcgcaaaggctttcgatttaaacgttccgtcggtctgcgaatggtacaaggaaagttacggccagtcaccggccacaatttatgaagcggtgcagggtaatcctgcttatcgcggcattgcgggacctattaaccttaacacgcgctacttcttcgaggatgtaagcaccggactggtaccgttatccgaactgggtcgggcagtgaatgtgcctaccccacttatcgatgctgttcttgacttgatcagttcgctgatagacacggatttcagaaaggaaggtcgtaccttggaaaaattaggtctgagcggacttaccgccgcgggcataagaagtgctgttgag

SEQ ID NO: 18 - protein, 359 aa, Artificial Sequence
  Engineered variant of opine dehydrogenase CENDH
MIESKTYAVLGLGNGGHAFAAYLALKGQSVLAWDIDAQRIKEIQDRGAIIAEGPGLAGTAHPDLLTSDIGLAVKDADVILIVVPAIHHASIAANIASYISEGQLIILNPGATGGALEFRKILRENGAPEVTIGETSSMLFTCRSERPGQVTVNAITGAMDFACLPAAKAGWALEQIGSVLPQYVAVENVLHTSLTNVNAVMHPLPTLLNAARCESGTPFQYYLEGITPSVGSLAEKVDAERIAIAKAFDLNVPSVCEWYKESYGQSPATIYEAVQGNPAYRGIAGPINLNTRYFFEDVSTGLVPLSELGRAVNVPTPLIDAVLDLISSLIDTDFRKEGRTLEKLGLSGLTAAGIRSAVE

SEQ ID NO: 19 - DNA, 1077 bp, Artificial Sequence
  Engineered variant of opine dehydrogenase CENDH
atgatcgagtcaaaaacatacgccgttttgggattaggaaacgggggtcacgcatttgccgcctatttagcattgaagggccagagtgtactggcttgggacatcgatgctcagagaatcaaagagattcaggaccgtggagccatcatagcggaaggaccaggacttgctgggactgctcacccggatcttctgacctcagatataggtttggcggttaaagacgctgatgtgatactgattgtagtgccggccatccaccacgcttccattgcagcaaatatcgccagttacatttccgagggtcagttgattatccttaaccctggggcaacgggtggagcgctggaattccggaaaatcctgcgtgaaaatggtgcgccggaggtaacgatcggggaaacctcaagtatgctctttacatgccgctccgagagaccaggacaggttacggtaaatgcgatacagggcgccatggactttgcatgtctcccagcggcaaaagctggatgggccctggaacagatagggtcggttcttcctcaatacgtggctgtcgaaaacgtgttgcatacttcgctgactaatgtgaacgctgtaatgcacccgctgccaacactgttaaacgctgctcgttgtgagtctggtaccccattccaatattatctggaggggattacgccatcagtcgggagtcttgcggagaaagtggacgctgaacgcatagcaatcgcaaaggctttcgatttaaacgttccgtcggtctgcgaatggtacaaggaaagttacggccagtcaccggccacaatttatgaagcggtgcagggtaatcctgcttatcgcggcattgcgggacctattaaccttaacacgcgctacttcttcgaggatgtaagcaccggactggtaccgttatccgaactgggtcgggcagtgaatgtgcctaccccacttatcgatgctgttcttgacttgatcagttcgctgatagacacggatttcagaaaggaaggtcgtaccttggaaaaattaggtctgagcggacttaccgccgcgggcataagaagtgctgttgag

SEQ ID NO: 20 - protein, 359 aa, Artificial Sequence
  Engineered variant of opine dehydrogenase CENDH
MIESKTYAVLGLGNGGHAFAAYLALKGQSVLAWDIDAQRIKEIQDRGAIIAEGPGLAGTAHPDLLTSDIGLAVKDADVILIVVPAIHHASIAANIASYISEGQLIILNPGATGGALEFRKILRENGAPEVTIGETSSMLFTCRSERPGQVTVNAIQGAMDFACLPAAKAGWALEQIGSVLPQYVAVENVLHTSLTNVNAVMHPLPTLLNAARCESGTPFQYYLEGITPSVGSLAEKVDAERIAIAKAFDLNVPSVCEWYKESYGQSPATIYEAVQGNPAYRGIAGPINLNTRYFFEDVSTGLVPLSELGRAVNVPTPLIDAVLDLISSLIDTDFRKEGRTLEKLGLSGLTAAGIRSAVE

SEQ ID NO: 21 - DNA, 1077 bp, Artificial Sequence
  Engineered variant of opine dehydrogenase CENDH
atgatcgagtcaaaaacatacgccgttttgggattaggaaacgggggtcacgcatttgccgcctatttagcattgaagggccagagtgtactggcttgggacatcgatgctcagagaatcaaagagattcaggaccgtggagccatcatagcggaaggaccaggacttgctgggactgctcacccggatcttctgacctcagatataggtttggcggttaaagacgctgatgtgatactgattgtagtgccggccatccaccacgcttccattgcagcaaatatcgccagttacatttccgagggtcagttgattatccttaaccctggggcaacgggtggagcgctggaattccggaaaatcctgcgtgaaaatggtgcgccggaggtaacgatcggggaaacctcaagtatgctctttacatgccgctccgagagaccaggacaggttacggtaaatgcgataagtggcgccatggactttgcatgtctcccagcggcaaaagctggatgggccctggaacagatagggtcggttcttcctcaatacgtggctgtcgaaaacgtgttgcatacttcgctgactaatgtgaacgctgtaatgcacccgctgccaacactgttaaacgctgctcgttgtgagtctggtaccccattccaatattatctggaggggattacgccatcagtcgggagtcttgcggagaaagtggacgctgaacgcatagcaatcgcaaaggctttcgatttaaacgttccgtcggtctgcgaatggtacaaggaaagttacggccagtcaccggccacaatttatgaagcggtgcagggtaatcctgcttatcgcggcattgcgggacctattaaccttaacacgcgctacttcttcgaggatgtaagcaccggactggtaccgttatccgaactgggtcgggcagtgaatgtgcctaccccacttatcgatgctgttcttgacttgatcagttcgctgatagacacggatttcagaaaggaaggtcgtaccttggaaaaattaggtctgagcggacttaccgccgcgggcataagaagtgctgttgag

SEQ ID NO: 22 - protein, 359 aa, Artificial Sequence
  Engineered variant of opine dehydrogenase CENDH
MIESKTYAVLGLGNGGHAFAAYLALKGQSVLAWDIDAQRIKEIQDRGAIIAEGPGLAGTAHPDLLTSDIGLAVKDADVILIVVPAIHHASIAANIASYISEGQLIILNPGATGGALEFRKILRENGAPEVTIGETSSMLFTCRSERPGQVTVNAISGAMDFACLPAAKAGWALEQIGSVLPQYVAVENVLHTSLTNVNAVMHPLPTLLNAARCESGTPFQYYLEGITPSVGSLAEKVDAERIAIAKAFDLNVPSVCEWYKESYGQSPATIYEAVQGNPAYRGIAGPINLNTRYFFEDVSTGLVPLSELGRAVNVPTPLIDAVLDLISSLIDTDFRKEGRTLEKLGLSGLTAAGIRSAVE

SEQ ID NO: 23 - DNA, 1077 bp, Artificial Sequence
  Engineered variant of opine dehydrogenase CENDH
atgatcgagtcaaaaacatacgccgttttgggattaggaaacgggggtcacgcatttgccgcctatttagcattgaagggccagagtgtactggcttgggacatcgatgctcagagaatcaaagagattcaggaccgtggagccatcatagcggaaggaccaggacttgctgggactgctcacccggatcttctgacctcagatataggtttggcggttaaagacgctgatgtgatactgattgtagtgccggccatccaccacgcttccattgcagcaaatatcgccagttacatttccgagggtcagttgattatccttaaccctggggcaacgggtggagcgctggaattccggaaaatcctgcgtgaaaatggtgcgccggaggtaacgatcggggaaacctcaagtatgctctttacatgccgctccgagagaccaggacaggttacggtaaatgcgataaaaggcgccatggactttgcatgtctcccagcggcaaaagctggatgggccctggaacagatagggtcggttcttcctcaatacgtggctgtcgaaaacgtgttgcatacttcgctgactaatgtgaacgctgtaatgcacccgctgccaacactgttaaacgctgctcgttgtgagtctggtaccccattccaatattatctggaggggattacgccatcagtcgggagtcttgcggagaaagtggacgctgaacgcatagcaatcgcaaaggctttcgatttaaacgttccgtcggtctgcgaatggagtaaggaaagttacggccagtcaccggccacaatttatgaagcggtgcagggtaatcctgcttatcgcggcattgcgggacctattaaccttaacacgcgctacttcttcgaggatgtaagcaccggactggtaccgttatccgaactgggtcgggcagtgaatgtgcctaccccacttatcgatgctgttcttgacttgatcagttcgctgatagacacggatttcagaaaggaaggtcgtaccttggaaaaattaggtctgagcggacttaccgccgcgggcataagaagtgctgttgag

SEQ ID NO: 24 - protein, 359 aa, Artificial Sequence
  Engineered variant of opine dehydrogenase CENDH
MIESKTYAVLGLGNGGHAFAAYLALKGQSVLAWDIDAQRIKEIQDRGAIIAEGPGLAGTAHPDLLTSDIGLAVKDADVILIVVPAIHHASIAANIASYISEGQLIILNPGATGGALEFRKILRENGAPEVTIGETSSMLFTCRSERPGQVTVNAIKGAMDFACLPAAKAGWALEQIGSVLPQYVAVENVLHTSLTNVNAVMHPLPTLLNAARCESGTPFQYYLEGITPSVGSLAEKVDAERIAIAKAFDLNVPSVCEWSKESYGQSPATIYEAVQGNPAYRGIAGPINLNTRYFFEDVSTGLVPLSELGRAVNVPTPLIDAVLDLISSLIDTDFRKEGRTLEKLGLSGLTAAGIRSAVE

SEQ ID NO: 25 - DNA, 1077 bp, Artificial Sequence
  Engineered variant of opine dehydrogenase CENDH
atgatcgagtcaaaaacatacgccgttttgggattaggaaacgggggtcacgcatttgccgcctatttagcattgaagggccagagtgtactggcttgggacatcgatgctcagagaatcaaagagattcaggaccgtggagccatcatagcggaaggaccaggacttgctgggactgctcacccggatcttctgacctcagatataggtttggcggttaaagacgctgatgtgatactgattgtagtgccggccatccaccacgcttccattgcagcaaatatcgccagttacatttccgagggtcagttgattatccttaaccctggggcaacgggtggagcgctggaattccggaaaatcctgcgtgaaaatggtgcgccggaggtaacgatcggggaaacctcaagtatgctctttacatgccgctccgagagaccaggacaggttacggtaaatgcgataaaaggcgccatggactttgcatgtctcccagcggcaaaagctggatgggccctggaacagatagggtcggttcttcctcaatacgtggctgtcgaaaacgtgttgcatacttcgctgactaatgtgaacgctgtaatgcacccgctgccaacactgttaaacgctgctcgttgtgagtctggtaccccattccaatattatctggaggggattacgccatcagtcgggagtcttgcggagaaagtggacgctgaacgcatagcaatcgcaaaggctttcgatttaaacgttccgtcggtctgcgaatggatgaaggaaagttacggccagtcaccggccacaatttatgaagcggtgcagggtaatcctgcttatcgcggcattgcgggacctattaaccttaacacgcgctacttcttcgaggatgtaagcaccggactggtaccgttatccgaactgggtcgggcagtgaatgtgcctaccccacttatcgatgctgttcttgacttgatcagttcgctgatagacacggatttcagaaaggaaggtcgtaccttggaaaaattaggtctgagcggacttaccgccgcgggcataagaagtgctgttgag

SEQ ID NO: 26 - protein, 359 aa, Artificial Sequence
  Engineered variant of opine dehydrogenase CENDH
MIESKTYAVLGLGNGGHAFAAYLALKGQSVLAWDIDAQRIKEIQDRGAIIAEGPGLAGTAHPDLLTSDIGLAVKDADVILIVVPAIHHASIAANIASYISEGQLIILNPGATGGALEFRKILRENGAPEVTIGETSSMLFTCRSERPGQVTVNAIKGAMDFACLPAAKAGWALEQIGSVLPQYVAVENVLHTSLTNVNAVMHPLPTLLNAARCESGTPFQYYLEGITPSVGSLAEKVDAERIAIAKAFDLNVPSVCEWMKESYGQSPATIYEAVQGNPAYRGIAGPINLNTRYFFEDVSTGLVPLSELGRAVNVPTPLIDAVLDLISSLIDTDFRKEGRTLEKLGLSGLTAAGIRSAVE

SEQ ID NO: 27 - DNA, 1077 bp, Artificial Sequence
  Engineered variant of opine dehydrogenase CENDH
atgatcgagtcaaaaacatacgccgttttgggattaggaaacgggggtcacgcatttgccgcctatttagcattgaagggccagagtgtactggcttgggacatcgatgctcagagaatcaaagagattcaggaccgtggagccatcatagcggaaggaccaggacttgctgggactgctcacccggatcttctgacctcagatataggtttggcggttaaagacgctgatgtgatactgattgtagtgccggccatccaccacgcttccattgcagcaaatatcgccagttacatttccgagggtcagttgattatccttaaccctggggcaacgggtggagcgctggaattccggaaaatcctgcgtgaaaatggtgcgccggaggtaacgatcggggaaacctcaagtatgctctttacatgccgctccgagagaccaggacaggttacggtaaatgcgataggtggcgccatggactttgcatgtctcccagcggcaaaagctggatgggccctggaacagatagggtcggttcttcctcaatacgtggctgtcgaaaacgtgttgcatacttcgctgactaatgtgaacgctgtaatgcacccgctgccaacactgttaaacgctgctcgttgtgagtctggtaccccattccaatattatctggaggggattacgccatcagtcgggagtcttgcggagaaagtggacgctgaacgcatagcaatcgcaaaggctttcgatttaaacgttccgtcggtctgcgaatggtacaaggaaagttacggccagtcaccggccacaatttatgaagcggtgcagggtaatcctgcttatcgcggcattgcgggacctattaaccttaacacgcgctacttcttcgaggatgtaagcaccggactggtaccgttatccgaactgggtcgggcagtgaatgtgcctaccccacttatcgatgctgttcttgacttgatcagttcgctgatagacacggatttcagaaaggaaggtcgtaccttggaaaaattaggtctgagcggacttaccgccgcgggcataagaagtgctgttgag

SEQ ID NO: 28 - protein, 359 aa, Artificial Sequence
  Engineered variant of opine dehydrogenase CENDH
MIESKTYAVLGLGNGGHAFAAYLALKGQSVLAWDIDAQRIKEIQDRGAIIAEGPGLAGTAHPDLLTSDIGLAVKDADVILIVVPAIHHASIAANIASYISEGQLIILNPGATGGALEFRKILRENGAPEVTIGETSSMLFTCRSERPGQVTVNAIGGAMDFACLPAAKAGWALEQIGSVLPQYVAVENVLHTSLTNVNAVMHPLPTLLNAARCESGTPFQYYLEGITPSVGSLAEKVDAERIAIAKAFDLNVPSVCEWYKESYGQSPATIYEAVQGNPAYRGIAGPINLNTRYFFEDVSTGLVPLSELGRAVNVPTPLIDAVLDLISSLIDTDFRKEGRTLEKLGLSGLTAAGIRSAVE

SEQ ID NO: 29 - DNA, 1077 bp, Artificial Sequence
  Engineered variant of opine dehydrogenase CENDH
atgatcgagtcaaaaacatacgccgttttgggattaggaaacgggggtcacgcatttgccgcctatttagcattgaagggccagagtgtactggcttgggacatcgatgctcagagaatcaaagagattcaggaccgtggagccatcatagcggaaggaccaggacttgctgggactgctcacccggatcttctgacctcagatataggtttggcggttaaagacgctgatgtgatactgattgtagtgccggccatccaccacgcttccattgcagcaaatatcgccagttacatttccgagggtcagttgattatccttaaccctggggcaacgggtggagcgctggaattccggaaaatcctgcgtgaaaatggtgcgccggaggtaacgatcggggaaaccggtagtatgctctttacatgccgctccgagagaccaggacaggttacggtaaatgcgataaaaggcgccatggactttgcatgtctcccagcggcaaaagctggatgggccctggaacagatagggtcggttcttcctcaatacgtggctgtcgaaaacgtgttgcatacttcgctgactaatgtgaacgctgtaatgcacccgctgccaacactgttaaacgctgctcgttgtgagtctggtaccccattccaatattatctggaggggattacgccatcagtcgggagtcttgcggagaaagtggacgctgaacgcatagcaatcgcaaaggctttcgatttaaacgttccgtcggtctgcgaatggtacaaggaaagttacggccagtcaccggccacaatttatgaagcggtgcagggtaatcctgcttatcgcggcattgcgggacctattaaccttaacacgcgctacttcttcgaggatgtaagcaccggactggtaccgttatccgaactgggtcgggcagtgaatgtgcctaccccacttatcgatgctgttcttgacttgatcagttcgctgatagacacggatttcagaaaggaaggtcgtaccttggaaaaattaggtctgagcggacttaccgccgcgggcataagaagtgctgttgag

SEQ ID NO: 30 - protein, 359 aa, Artificial Sequence
  Engineered variant of opine dehydrogenase CENDH
MIESKTYAVLGLGNGGHAFAAYLALKGQSVLAWDIDAQRIKEIQDRGAIIAEGPGLAGTAHPDLLTSDIGLAVKDADVILIVVPAIHHASIAANIASYISEGQLIILNPGATGGALEFRKILRENGAPEVTIGETGSMLFTCRSERPGQVTVNAIKGAMDFACLPAAKAGWALEQIGSVLPQYVAVENVLHTSLTNVNAVMHPLPTLLNAARCESGTPFQYYLEGITPSVGSLAEKVDAERIAIAKAFDLNVPSVCEWYKESYGQSPATIYEAVQGNPAYRGIAGPINLNTRYFFEDVSTGLVPLSELGRAVNVPTPLIDAVLDLISSLIDTDFRKEGRTLEKLGLSGLTAAGIRSAVE

SEQ ID NO: 31 - DNA, 1077 bp, Artificial Sequence
  Engineered variant of opine dehydrogenase CENDH
atgatcgagtcaaaaacatacgccgttttgggattaggaaacgggggtcacgcatttgccgcctatttagcattgaagggccagagtgtactggcttgggacatcgatgctcagagaatcaaagagattcaggaccgtggagccatcatagcggaaggaccaggacttgctgggactgctcacccggatcttctgacctcagatataggtttggcggttaaagacgctgatgtgatactgattgtagtgccggccatccaccacgcttccattgcagcaaatatcgccagttacatttccgagggtcagttgattatccttaaccctggggcaacgggtggagcgctggaattccggaaaatcctgcgtgaaaatggtgcgccggaggtaacgatcggggaaacctcaagtatgctctttacatgccgctccgagagaccaggacaggttacggtaaatgcgataaaaggcgccatggactttgcatgtctcccagcggcaaaagctggatgggccctggaacagatagggtcggttcttcctcaatacgtggctgtcgaaaacgtgttgcatacttcgctgactaatgtgaacgctgtaatgcacccgctgccaacactgttaaacgctgctcgttgtgagtctggtaccccattccaatattatctggaggggattacgccatcagtcgggagtcttgcggagaaagtggacgctgaacgcatagcaatcgcaaaggctttcgatttaaacgttccgtcggtctgcgaatggcataaggaaagttacggccagtcaccggccacaatttatgaagcggtgcagggtaatcctgcttatcgcggcattgcgggacctattaaccttaacacgcgctacttcttcgaggatgtaagcaccggactggtaccgttatccgaactgggtcgggcagtgaatgtgcctaccccacttatcgatgctgttcttgacttgatcagttcgctgatagacacggatttcagaaaggaaggtcgtaccttggaaaaattaggtctgagcggacttaccgccgcgggcataagaagtgctgttgag

SEQ ID NO: 32 - protein, 359 aa, Artificial Sequence
  Engineered variant of opine dehydrogenase CENDH
MIESKTYAVLGLGNGGHAFAAYLALKGQSVLAWDIDAQRIKEIQDRGAIIAEGPGLAGTAHPDLLTSDIGLAVKDADVILIVVPAIHHASIAANIASYISEGQLIILNPGATGGALEFRKILRENGAPEVTIGETSSMLFTCRSERPGQVTVNAIKGAMDFACLPAAKAGWALEQIGSVLPQYVAVENVLHTSLTNVNAVMHPLPTLLNAARCESGTPFQYYLEGITPSVGSLAEKVDAERIAIAKAFDLNVPSVCEWHKESYGQSPATIYEAVQGNPAYRGIAGPINLNTRYFFEDVSTGLVPLSELGRAVNVPTPLIDAVLDLISSLIDTDFRKEGRTLEKLGLSGLTAAGIRSAVE

SEQ ID NO: 33 - DNA, 1077 bp, Artificial Sequence
  Engineered variant of opine dehydrogenase CENDH
atgatcgagtcaaaaacatacgccgttttgggattaggaaacgggggtcacgcatttgccgcctatttagcattgaagggccagagtgtactggcttgggacatcgatgctcagagaatcaaagagattcaggaccgtggagccatcatagcggaaggaccaggacttgctgggactgctcacccggatcttctgacctcagatataggtttggcggttaaagacgctgatgtgatactgattgtagtgccggccatccaccacgcttccattgcagcaaatatcgccagttacatttccgagggtcagttgattatccttaaccctggggcaacgggtggagcgctggaattccggaaaatcctgcgtgaaaatggtgcgccggaggtaacgatcggggaaacctcaagtatgctctttacatgccgctccgagagaccaggacaggttacggtaaatgcgataaaaggcgccatggactttgcatgtctcccagcggcaaaagctggatgggccctggaacagatagggtcggttcttcctcaatacgtggctgtcgaaaacgtgttgcatacttcgctgactaatgtgaacgctgtacttcacccgctgccaacactgttaaacgctgctcgttgtgagtctggtaccccattccaatattatctggaggggattacgccatcagtcgggagtcttgcggagaaagtggacgctgaacgcatagcaatcgcaaaggctttcgatttaaacgttccgtcggtctgcgaatggtacaaggaaagttacggccagtcaccggccacaatttatgaagcggtgcagggtaatcctgcttatcgcggcattgcgggacctattaaccttaacacgcgctacttcttcgaggatgtaagcaccggactggtaccgttatccgaactgggtcgggcagtgaatgtgcctaccccacttatcgatgctgttcttgacttgatcagttcgctgatagacacggatttcagaaaggaaggtcgtaccttggaaaaattaggtctgagcggacttaccgccgcgggcataagaagtgctgttgag

SEQ ID NO: 34 - protein, 359 aa, Artificial Sequence
  Engineered variant of opine dehydrogenase CENDH
MIESKTYAVLGLGNGGHAFAAYLALKGQSVLAWDIDAQRIKEIQDRGAIIAEGPGLAGTAHPDLLTSDIGLAVKDADVILIVVPAIHHASIAANIASYISEGQLIILNPGATGGALEFRKILRENGAPEVTIGETSSMLFTCRSERPGQVTVNAIKGAMDFACLPAAKAGWALEQIGSVLPQYVAVENVLHTSLTNVNAVLHPLPTLLNAARCESGTPFQYYLEGITPSVGSLAEKVDAERIAIAKAFDLNVPSVCEWYKESYGQSPATIYEAVQGNPAYRGIAGPINLNTRYFFEDVSTGLVPLSELGRAVNVPTPLIDAVLDLISSLIDTDFRKEGRTLEKLGLSGLTAAGIRSAVE

SEQ ID NO: 35 - DNA, 1077 bp, Artificial Sequence
  Engineered variant of opine dehydrogenase CENDH
atgatcgagtcaaaaacatacgccgttttgggattaggaaacgggggtcacgcatttgccgcctatttagcattgaagggccagagtgtactggcttgggacatcgatgctcagagaatcaaagagattcaggaccgtggagccatcatagcggaaggaccaggacttgctgggactgctcacccggatcttctgacctcagatataggtttggcggttaaagacgctgatgtgatactgattgtagtgccggccatccaccacgcttccattgcagcaaatatcgccagttacatttccgagggtcagttgattatccttaaccctggggcaacgggtggagcgctggaattccggaaaatcctgcgtgaaaatggtgcgccggaggtaacgatcggggaaacctcaagtatgctctttacatgccgctccgagagaccaggacaggttacggtaaatgcgataaaaggcgccatggactttgcatgtctcccagcggcaaaagctggatgggccctggaacagatagggtcggttcttcctcaatacgtggctgtcgaaaacgtgttgcatacttcgctgactaatgtgaacgctgtaatgcacccgctgccaacactgttaaacgctgctcgttgtgagtctggtaccccattccaatattatctggaggggattacgccatcagtcgggagtcttgcggagaaagtggacgctgaacgcatagcaatcgcaaaggctttcgatttaaacgttccgtcggtctgcgaatggtacaaggaaagttacggccagtcaccggccacaatttatgaagcggtgcagggtaatcctgctctgcgcggcattgcgggacctattaaccttaacacgcgctacttcttcgaggatgtaagcaccggactggtaccgttatccgaactgggtcgggcagtgaatgtgcctaccccacttatcgatgctgttcttgacttgatcagttcgctgatagacacggatttcagaaaggaaggtcgtaccttggaaaaattaggtctgagcggacttaccgccgcgggcataagaagtgctgttgag

SEQ ID NO: 36 - protein, 359 aa, Artificial Sequence
  Engineered variant of opine dehydrogenase CENDH
MIESKTYAVLGLGNGGHAFAAYLALKGQSVLAWDIDAQRIKEIQDRGAIIAEGPGLAGTAHPDLLTSDIGLAVKDADVILIVVPAIHHASIAANIASYISEGQLIILNPGATGGALEFRKILRENGAPEVTIGETSSMLFTCRSERPGQVTVNAIKGAMDFACLPAAKAGWALEQIGSVLPQYVAVENVLHTSLTNVNAVMHPLPTLLNAARCESGTPFQYYLEGITPSVGSLAEKVDAERIAIAKAFDLNVPSVCEWYKESYGQSPATIYEAVQGNPALRGIAGPINLNTRYFFEDVSTGLVPLSELGRAVNVPTPLIDAVLDLISSLIDTDFRKEGRTLEKLGLSGLTAAGIRSAVE

SEQ ID NO: 37 - DNA, 1077 bp, Artificial Sequence
  Engineered variant of opine dehydrogenase CENDH
atgatcgagtcaaaaacatacgccgttttgggattaggaaacgggggtcacgcatttgccgcctatttagcattgaagggccagagtgtactggcttgggacatcgatgctcagagaatcaaagagattcaggaccgtggagccatcatagcggaaggaccaggacttgctgggactgctcacccggatcttctgacctcagatataggtttggcggttaaagacgctgatgtgatactgattgtagtgccggccatccaccacgcttccattgcagcaaatatcgccagttacatttccgagggtcagttgattatccttaaccctggggcaacgggtggagcgctggaattccggaaaatcctgcgtgaaaatggtgcgccggaggtaacgatcggggaaacctcaagtatgctctttacatgccgctccgagagaccaggacaggttacggtaaatgcgataaaaggcgccatggactttgcatgtctcccagcggcaaaagctggatgggccctggaacagatagggtcggttcttcctcaatacgtggctgtcgaaaacgtgttgcatacttcgctgactaatgtgaacgctgtaatgcacccgctgccaacactgttaaacgctgctcgttgtgagtctggtaccccattccaatattatctggaggggattacgccatcagtcgggagtcttgcggagaaagtggacgctgaacgcatagcaatcgcaaaggctttcgatttaaacgttccgtcggtctgcgaatggattaaggaaagttacggccagtcaccggccacaatttatgaagcggtgcagggtaatcctgcttatcgcggcattgcgggacctattaaccttaacacgcgctacttcttcgaggatgtaagcaccggactggtaccgttatccgaactgggtcgggcagtgaatgtgcctaccccacttatcgatgctgttcttgacttgatcagttcgctgatagacacggatttcagaaaggaaggtcgtaccttggaaaaattaggtctgagcggacttaccgccgcgggcataagaagtgctgttgag

SEQ ID NO: 38 - protein, 359 aa, Artificial Sequence
  Engineered variant of opine dehydrogenase CENDH
MIESKTYAVLGLGNGGHAFAAYLALKGQSVLAWDIDAQRIKEIQDRGAIIAEGPGLAGTAHPDLLTSDIGLAVKDADVILIVVPAIHHASIAANIASYISEGQLIILNPGATGGALEFRKILRENGAPEVTIGETSSMLFTCRSERPGQVTVNAIKGAMDFACLPAAKAGWALEQIGSVLPQYVAVENVLHTSLTNVNAVMHPLPTLLNAARCESGTPFQYYLEGITPSVGSLAEKVDAERIAIAKAFDLNVPSVCEWIKESYGQSPATIYEAVQGNPAYRGIAGPINLNTRYFFEDVSTGLVPLSELGRAVNVPTPLIDAVLDLISSLIDTDFRKEGRTLEKLGLSGLTAAGIRSAVE

SEQ ID NO: 39 - DNA, 1077 bp, Artificial Sequence
  Engineered variant of opine dehydrogenase CENDH
atgatcgagtcaaaaacatacgccgttttgggattaggaaacgggggtcacgcatttgccgcctatttagcattgaagggccagagtgtactggcttgggacatcgatgctcagagaatcaaagagattcaggaccgtggagccatcatagcggaaggaccaggacttgctgggactgctcacccggatcttctgacctcagatataggtttggcggttaaagacgctgatgtgatactgattgtagtgccggccatccaccacgcttccattgcagcaaatatcgccagttacatttccgagggtcagttgattatccttaaccctggggcaacgggtggagcgctggaattccggaaaatcctgcgtgaaaatggtgcgccggaggtaacgatcggggaaacctcaagtatgctctttacatgccgctccgagagaccaggacaggttacggtaaatgcgataaaaggcgccatggactttgcatgtctcccagcggcaaaagctggatgggccctggaacagatagggtcggttcttcctcaatacgtggctgtcgaaaacgtgttgcatacttcgctgactaatgtgagtgctgtaatgcacccgctgccaacactgttaaacgctgctcgttgtgagtctggtaccccattccaatattatctggaggggattacgccatcagtcgggagtcttgcggagaaagtggacgctgaacgcatagcaatcgcaaaggctttcgatttaaacgttccgtcggtctgcgaatggtacaaggaaagttacggccagtcaccggccacaatttatgaagcggtgcagggtaatcctgcttatcgcggcattgcgggacctattaaccttaacacgcgctacttcttcgaggatgtaagcaccggactggtaccgttatccgaactgggtcgggcagtgaatgtgcctaccccacttatcgatgctgttcttgacttgatcagttcgctgatagacacggatttcagaaaggaaggtcgtaccttggaaaaattaggtctgagcggacttaccgccgcgggcataagaagtgctgttgag

SEQ ID NO: 40 - protein, 359 aa, Artificial Sequence
  Engineered variant of opine dehydrogenase CENDH
MIESKTYAVLGLGNGGHAFAAYLALKGQSVLAWDIDAQRIKEIQDRGAIIAEGPGLAGTAHPDLLTSDIGLAVKDADVILIVVPAIHHASIAANIASYISEGQLIILNPGATGGALEFRKILRENGAPEVTIGETSSMLFTCRSERPGQVTVNAIKGAMDFACLPAAKAGWALEQIGSVLPQYVAVENVLHTSLTNVSAVMHPLPTLLNAARCESGTPFQYYLEGITPSVGSLAEKVDAERIAIAKAFDLNVPSVCEWYKESYGQSPATIYEAVQGNPAYRGIAGPINLNTRYFFEDVSTGLVPLSELGRAVNVPTPLIDAVLDLISSLIDTDFRKEGRTLEKLGLSGLTAAGIRSAVE

SEQ ID NO: 41 - DNA, 1077 bp, Artificial Sequence
  Engineered variant of opine dehydrogenase CENDH
atgatcgagtcaaaaacatacgccgttttgggattaggaaacgggggtcacgcatttgccgcctatttagcattgaagggccagagtgtactggcttgggacatcgatgctcagagaatcaaagagattcaggaccgtggagccatcatagcggaaggaccaggacttgctgggactgctcacccggatcttctgacctcagatataggtttggcggttaaagacgctgatgtgatactgattgtagtgccggccatccaccacgcttccattgcagcaaatatcgccagttacatttccgagggtcagttgattatccttaaccctggggcaacgggtggagcgctggaattccggaaaatcctgcgtgaaaatggtgcgccggaggtaacgatcggggaaacctcaagtatgctctttacatgccgctccgagagaccaggacaggttacggtaaatgcgataaaaggcgccatggactttgcatgtctcccagcggcaaaagctggatgggccctggaacagatagggtcggttcttcctcaatacgtggctgtcgaaaacgtgttgcatacttcgctgactaatgtgaacgctgtaatgcacccgctgccaacactgttaaacgctgctcgttgtgagtctggtaccccattccaatattatctggaggggattacgccatcagtcgggagtcttgcggagaaagtggacgctgaacgcatagcaatcgcaaaggctttcgatttaaacgttccgtcggtctgcgaatggctgaaggaaagttacggccagtcaccggccacaatttatgaagcggtgcagggtaatcctgcttatcgcggcattgcgggacctattaaccttaacacgcgctacttcttcgaggatgtaagcaccggactggtaccgttatccgaactgggtcgggcagtgaatgtgcctaccccacttatcgatgctgttcttgacttgatcagttcgctgatagacacggatttcagaaaggaaggtcgtaccttggaaaaattaggtctgagcggacttaccgccgcgggcataagaagtgctgttgag

SEQ ID NO: 42 - protein, 359 aa, Artificial Sequence
  Engineered variant of opine dehydrogenase CENDH
MIESKTYAVLGLGNGGHAFAAYLALKGQSVLAWDIDAQRIKEIQDRGAIIAEGPGLAGTAHPDLLTSDIGLAVKDADVILIVVPAIHHASIAANIASYISEGQLIILNPGATGGALEFRKILRENGAPEVTIGETSSMLFTCRSERPGQVTVNAIKGAMDFACLPAAKAGWALEQIGSVLPQYVAVENVLHTSLTNVNAVMHPLPTLLNAARCESGTPFQYYLEGITPSVGSLAEKVDAERIAIAKAFDLNVPSVCEWLKESYGQSPATIYEAVQGNPAYRGIAGPINLNTRYFFEDVSTGLVPLSELGRAVNVPTPLIDAVLDLISSLIDTDFRKEGRTLEKLGLSGLTAAGIRSAVE

SEQ ID NO: 43 - DNA, 1077 bp, Artificial Sequence
  Engineered variant of opine dehydrogenase CENDH
atgatcgagtcaaaaacatacgccgttttgggattaggaaacgggggtcacgcatttgccgcctatttagcattgaagggccagagtgtactggcttgggacatcgatgctcagagaatcaaagagattcaggaccgtggagccatcatagcggaaggaccaggacttgctgggactgctcacccggatcttctgacctcagatataggtttggcggttaaagacgctgatgtgatactgattgtagtgccggccatccaccacgcttccattgcagcaaatatcgccagttacatttccgagggtcagttgattatccttaaccctggggcaacgggtggagcgctggaattccggaaaatcctgcgtgaaaatggtgcgccggaggtaacgatcggggaaacctcaagtatgctctttacatgccgctccgagagaccaggacaggttacggtaaatgcgataaaaggcgccatggactttgcatgtctcccagcggcaaaagctggatgggccctggaacagatagggtcggttcttcctcaatacgtggctgtcgaaaacgtgttgcatacttcgctgactaatgtgaacgctgtaatgcacccgctgccaacactgttaaacgctgctcgttgtgagtctggtaccccattccaatattatctggaggggattacgccatcagtcgggagtcttgcggagaaagtggacgctgaacgcatagcaatcgcaaaggctttcgatttaaacgttccgtcggtctgcgaatgggagaaggaaagttacggccagtcaccggccacaatttatgaagcggtgcagggtaatcctgcttatcgcggcattgcgggacctattaaccttaacacgcgctacttcttcgaggatgtaagcaccggactggtaccgttatccgaactgggtcgggcagtgaatgtgcctaccccacttatcgatgctgttcttgacttgatcagttcgctgatagacacggatttcagaaaggaaggtcgtaccttggaaaaattaggtctgagcggacttaccgccgcgggcataagaagtgctgttgag

SEQ ID NO: 44 - protein, 359 aa, Artificial Sequence
  Engineered variant of opine dehydrogenase CENDH
MIESKTYAVLGLGNGGHAFAAYLALKGQSVLAWDIDAQRIKEIQDRGAIIAEGPGLAGTAHPDLLTSDIGLAVKDADVILIVVPAIHHASIAANIASYISEGQLIILNPGATGGALEFRKILRENGAPEVTIGETSSMLFTCRSERPGQVTVNAIKGAMDFACLPAAKAGWALEQIGSVLPQYVAVENVLHTSLTNVNAVMHPLPTLLNAARCESGTPFQYYLEGITPSVGSLAEKVDAERIAIAKAFDLNVPSVCEWEKESYGQSPATIYEAVQGNPAYRGIAGPINLNTRYFFEDVSTGLVPLSELGRAVNVPTPLIDAVLDLISSLIDTDFRKEGRTLEKLGLSGLTAAGIRSAVE

SEQ ID NO: 45 - DNA, 1077 bp, Artificial Sequence
  Engineered variant of opine dehydrogenase CENDH
atgatcgagtcaaaaacatacgccgttttgggattaggaaacgggggtcacgcatttgccgcctatttagcattgaagggccagagtgtactggcttgggacatcgatgctcagagaatcaaagagattcaggaccgtggagccatcatagcggaaggaccaggacttgctgggactgctcacccggatcttctgacctcagatataggtttggcggttaaagacgctgatgtgatactgattgtagtgccggccatccaccacgcttccattgcagcaaatatcgccagttacatttccgagggtcagttgattatccttaaccctgggagtacgggtggagcgctggaattccggaaaatcctgcgtgaaaatggtgcgccggaggtaacgatcggggaaacctcaagtatgctctttacatgccgctccgagagaccaggacaggttacggtaaatgcgataaaaggcgccatggactttgcatgtctcccagcggcaaaagctggatgggccctggaacagatagggtcggttcttcctcaatacgtggctgtcgaaaacgtgttgcatacttcgctgactaatgtgaacgctgtaatgcacccgctgccaacactgttaaacgctgctcgttgtgagtctggtaccccattccaatattatctggaggggattacgccatcagtcgggagtcttgcggagaaagtggacgctgaacgcatagcaatcgcaaaggctttcgatttaaacgttccgtcggtctgcgaatggtacaaggaaagttacggccagtcaccggccacaatttatgaagcggtgcagggtaatcctgcttatcgcggcattgcgggacctattaaccttaacacgcgctacttcttcgaggatgtaagcaccggactggtaccgttatccgaactgggtcgggcagtgaatgtgcctaccccacttatcgatgctgttcttgacttgatcagttcgctgatagacacggatttcagaaaggaaggtcgtaccttggaaaaattaggtctgagcggacttaccgccgcgggcataagaagtgctgttgag

SEQ ID NO: 46 - protein, 359 aa, Artificial Sequence
  Engineered variant of opine dehydrogenase CENDH
MIESKTYAVLGLGNGGHAFAAYLALKGQSVLAWDIDAQRIKEIQDRGAIIAEGPGLAGTAHPDLLTSDIGLAVKDADVILIVVPAIHHASIAANIASYISEGQLIILNPGSTGGALEFRKILRENGAPEVTIGETSSMLFTCRSERPGQVTVNAIKGAMDFACLPAAKAGWALEQIGSVLPQYVAVENVLHTSLTNVNAVMHPLPTLLNAARCESGTPFQYYLEGITPSVGSLAEKVDAERIAIAKAFDLNVPSVCEWYKESYGQSPATIYEAVQGNPAYRGIAGPINLNTRYFFEDVSTGLVPLSELGRAVNVPTPLIDAVLDLISSLIDTDFRKEGRTLEKLGLSGLTAAGIRSAVE

SEQ ID NO: 47 - DNA, 1077 bp, Artificial Sequence
  Engineered variant of opine dehydrogenase CENDH
atgatcgagtcaaaaacatacgccgttttgggattaggaaacgggggtcacgcatttgccgcctatttagcattgaagggccagagtgtactggcttgggacatcgatgctcagagaatcaaagagattcaggaccgtggagccatcatagcggaaggaccaggacttgctgggactgctcacccggatcttctgacctcagatataggtttggcggttaaagacgctgatgtgatactgattgtagtgccggccatccaccacgcttccattgcagcaaatatcgccagttacatttccgagggtcagttgattatccttaaccctggggcaacgggtggagcgctggaattccggaaaatcctgcgtgaaaatggtgcgccggaggtaacgatcggggaaacctcaagtatgctctttacatgccgctccgagagaccaggacaggttacggtaaatgcgataaaaggcgccatggactttgcatgtctcccagcggcaaaagctggatgggccctggaacagatagggtcggttcttcctcaatacgtggctgtcgaaaacgtgttgcatacttcgctgactaatgtgaacgctgtaatgcacccgctgccaacactgttaaacgctgctcgttgtgagtctggtaccccattccaatattatctggaggggattacgccatcagtcgggagtcttgcggagaaagtggacgctgaacgcatagcaatcgcaaaggctttcgatttaaacgttccgtcggtctgcgaatggtacaaggaaagttacggccagtcaccggccacaatttatgaagcggtgcagggtaatcctgcttatcgcggcattgcgggacctattaaccttaacacgcgcactttcttcgaggatgtaagcaccggactggtaccgttatccgaactgggtcgggcagtgaatgtgcctaccccacttatcgatgctgttcttgacttgatcagttcgctgatagacacggatttcagaaaggaaggtcgtaccttggaaaaattaggtctgagcggacttaccgccgcgggcataagaagtgctgttgag

SEQ ID NO: 48 - protein, 359 aa, Artificial Sequence
  Engineered variant of opine dehydrogenase CENDH
MIESKTYAVLGLGNGGHAFAAYLALKGQSVLAWDIDAQRIKEIQDRGAIIAEGPGLAGTAHPDLLTSDIGLAVKDADVILIVVPAIHHASIAANIASYISEGQLIILNPGATGGALEFRKILRENGAPEVTIGETSSMLFTCRSERPGQVTVNAIKGAMDFACLPAAKAGWALEQIGSVLPQYVAVENVLHTSLTNVNAVMHPLPTLLNAARCESGTPFQYYLEGITPSVGSLAEKVDAERIAIAKAFDLNVPSVCEWYKESYGQSPATIYEAVQGNPAYRGIAGPINLNTRTFFEDVSTGLVPLSELGRAVNVPTPLIDAVLDLISSLIDTDFRKEGRTLEKLGLSGLTAAGIRSAVE

SEQ ID NO: 49 - DNA, 1077 bp, Artificial Sequence
  Engineered variant of opine dehydrogenase CENDH
atgatcgagtcaaaaacatacgccgttttgggattaggaaacgggggtcacgcatttgccgcctatttagcattgaagggccagagtgtactggcttgggacatcgatgctcagagaatcaaagagattcaggaccgtggagccatcatagcggaaggaccaggacttgctgggactgctcacccggatcttctgacctcagatataggtttggcggttaaagacgctgatgtgatactgattgtagtgccggccatccaccacgcttccattgcagcaaatatcgccagttacatttccgagggtcagttgattatccttaaccctgggcagacgggtggagcgctggaattccggaaaatcctgcgtgaaaatggtgcgccggaggtaacgatcggggaaacctcaagtatgctctttacatgccgctccgagagaccaggacaggttacggtaaatgcgataaaaggcgccatggactttgcatgtctcccagcggcaaaagctggatgggccctggaacagatagggtcggttcttcctcaatacgtggctgtcgaaaacgtgttgcatacttcgctgactaatgtgaacgctgtaatgcacccgctgccaacactgttaaacgctgctcgttgtgagtctggtaccccattccaatattatctggaggggattacgccatcagtcgggagtcttgcggagaaagtggacgctgaacgcatagcaatcgcaaaggctttcgatttaaacgttccgtcggtctgcgaatggtacaaggaaagttacggccagtcaccggccacaatttatgaagcggtgcagggtaatcctgcttatcgcggcattgcgggacctattaaccttaacacgcgctacttcttcgaggatgtaagcaccggactggtaccgttatccgaactgggtcgggcagtgaatgtgcctaccccacttatcgatgctgttcttgacttgatcagttcgctgatagacacggatttcagaaaggaaggtcgtaccttggaaaaattaggtctgagcggacttaccgccgcgggcataagaagtgctgttgag

SEQ ID NO: 50 - protein, 359 aa, Artificial Sequence
  Engineered variant of opine dehydrogenase CENDH
MIESKTYAVLGLGNGGHAFAAYLALKGQSVLAWDIDAQRIKEIQDRGAIIAEGPGLAGTAHPDLLTSDIGLAVKDADVILIVVPAIHHASIAANIASYISEGQLIILNPGQTGGALEFRKILRENGAPEVTIGETSSMLFTCRSERPGQVTVNAIKGAMDFACLPAAKAGWALEQIGSVLPQYVAVENVLHTSLTNVNAVMHPLPTLLNAARCESGTPFQYYLEGITPSVGSLAEKVDAERIAIAKAFDLNVPSVCEWYKESYGQSPATIYEAVQGNPAYRGIAGPINLNTRYFFEDVSTGLVPLSELGRAVNVPTPLIDAVLDLISSLIDTDFRKEGRTLEKLGLSGLTAAGIRSAVE

SEQ ID NO: 51 - DNA, 1077 bp, Artificial Sequence
  Engineered variant of opine dehydrogenase CENDH
atgatcgagtcaaaaacatacgccgttttgggattaggaaacgggggtcacgcatttgccgcctatttagcattgaagggccagagtgtactggcttgggacatcgatgctcagagaatcaaagagattcaggaccgtggagccatcatagcggaaggaccaggacttgctgggactgctcacccggatcttctgacctcagatataggtttggcggttaaagacgctgatgtgatactgattgtagtgccggccatccaccacgcttccattgcagcaaatatcgccagttacatttccgagggtcagttgattatccttaaccctggggcaacgggtggagcgctggaattccggaaaatcctgcgtgaaaatggtgcgccggaggtaacgatcggggaaacctcaagtatgctctttacatgccgctccgagagaccaggacaggttacggtaaatgcgataaaaggcgccatggactttgcatgtctcccagcggcaaaagctggatgggccctggaacagatagggtcggttcttcctcaatacgtggctgtcgaaaacgtgttgcatacttcgctgactaatgtgaacgctgtaatgcacccgctgccaacactgttaaacgctgctcgttgtgagtctggtaccccattccaatattatctggaggggattacgccatcagtcgggagtcttgcggagaaagtggacgctgaacgcatagcaatcgcaaaggctttcgatttaaacgttccgtcggtctgcgaatggtacaaggaaagttacggccagtcaccggccacaatttatgaagcggtgcagggtaatcctgcttatcgcggcattgcgggacctattaaccttaacacgcgccagttcttcgaggatgtaagcaccggactggtaccgttatccgaactgggtcgggcagtgaatgtgcctaccccacttatcgatgctgttcttgacttgatcagttcgctgatagacacggatttcagaaaggaaggtcgtaccttggaaaaattaggtctgagcggacttaccgccgcgggcataagaagtgctgttgag

SEQ ID NO: 52 - protein, 359 aa, Artificial Sequence
  Engineered variant of opine dehydrogenase CENDH
MIESKTYAVLGLGNGGHAFAAYLALKGQSVLAWDIDAQRIKEIQDRGAIIAEGPGLAGTAHPDLLTSDIGLAVKDADVILIVVPAIHHASIAANIASYISEGQLIILNPGATGGALEFRKILRENGAPEVTIGETSSMLFTCRSERPGQVTVNAIKGAMDFACLPAAKAGWALEQIGSVLPQYVAVENVLHTSLTNVNAVMHPLPTLLNAARCESGTPFQYYLEGITPSVGSLAEKVDAERIAIAKAFDLNVPSVCEWYKESYGQSPATIYEAVQGNPAYRGIAGPINLNTRQFFEDVSTGLVPLSELGRAVNVPTPLIDAVLDLISSLIDTDFRKEGRTLEKLGLSGLTAAGIRSAVE

SEQ ID NO: 53 - DNA, 1077 bp, Artificial Sequence
  Engineered variant of opine dehydrogenase CENDH
atgatcgagtcaaaaacatacgccgttttgggattaggaaacgggggtcacgcatttgccgcctatttagcattgaagggccagagtgtactggcttgggacatcgatgctcagagaatcaaagagattcaggaccgtggagccatcatagcggaaggaccaggacttgctgggactgctcacccggatcttctgacctcagatataggtttggcggttaaagacgctgatgtgatactgattgtagtgccggccatccaccacgcttccattgcagcaaatatcgccagttacatttccgagggtcagttgattatccttaaccctggggcaacgggtggagcgctggaattccggaaaatcctgcgtgaaaatggtgcgccggaggtaacgatcggggaaacctcaagtatgctctttacatgccgctccgagagaccaggacaggttacggtaaatgcgataaaaggcgccatggactttgcatgtctcccagcggcaaaagctggatgggccctggaacagatagggtcggttcttcctcaatacgtggctgtcgaaaacgtgttgcatacttcgctgactaatgtgaacgctgtaatgcacccgctgccaacactgttaaacgctgctcgttgtgagtctggtaccccattccaatattatctggaggggattacgccatcagtcgggagtcttgcggagaaagtggacgctgaacgcatagcaatcgcaaaggctttcgatttaaacgttccgtcggtctgcgaatggtacaaggaaagttacggccagtcaccggccacaatttatgaagcggtgcagggtaatcctgcttatcgcggcattgcgggacctattaaccttaacacgcgcttgttcttcgaggatgtaagcaccggactggtaccgttatccgaactgggtcgggcagtgaatgtgcctaccccacttatcgatgctgttcttgacttgatcagttcgctgatagacacggatttcagaaaggaaggtcgtaccttggaaaaattaggtctgagcggacttaccgccgcgggcataagaagtgctgttgag

SEQ ID NO: 54 - protein, 359 aa, Artificial Sequence
  Engineered variant of opine dehydrogenase CENDH
MIESKTYAVLGLGNGGHAFAAYLALKGQSVLAWDIDAQRIKEIQDRGAIIAEGPGLAGTAHPDLLTSDIGLAVKDADVILIVVPAIHHASIAANIASYISEGQLIILNPGATGGALEFRKILRENGAPEVTIGETSSMLFTCRSERPGQVTVNAIKGAMDFACLPAAKAGWALEQIGSVLPQYVAVENVLHTSLTNVNAVMHPLPTLLNAARCESGTPFQYYLEGITPSVGSLAEKVDAERIAIAKAFDLNVPSVCEWYKESYGQSPATIYEAVQGNPAYRGIAGPINLNTRLFFEDVSTGLVPLSELGRAVNVPTPLIDAVLDLISSLIDTDFRKEGRTLEKLGLSGLTAAGIRSAVE

SEQ ID NO: 55 - DNA, 1077 bp, Artificial Sequence
  Engineered variant of opine dehydrogenase CENDH
atgatcgagtcaaaaacatacgccgttttgggattaggaaacgggggtcacgcatttgccgcctatttagcattgaagggccagagtgtactggcttgggacatcgatgctcagagaatcaaagagattcaggaccgtggagccatcatagcggaaggaccaggacttgctgggactgctcacccggatcttctgacctcagatataggtttggcggttaaagacgctgatgtgatactgattgtagtgccggccatccaccacgcttccattgcagcaaatatcgccagttacatttccgagggtcagttgattatccttaaccctggggcaacgggtggagcgctggaattccggaaaatcctgcgtgaaaatggtgcgccggaggtaacgatcggggaaacctcaagtatgctctttacatgccgctccgagagaccaggacaggttacggtaaatgcgataaaaggcgccatggactttgcatgtctcccagcggcaaaagctggatgggccctggaacagatagggtcggttcttcctcaatacgtggctgtcgaaaacgtgttgcatacttcgctgactaatgtgaacgctgtaatgcacccgctgccaacactgttaaacgctgctcgttgtgagtctggtaccccattccaatattatctggaggggattacgccatcagtcgggagtcttgcggagaaagtggacgctgaacgcatagcaatcgcaaaggctttcgatttaaacgttccgtcggtctgcgaatggtacaaggaaagttacggccagtcaccggccacaatttatgaagcggtgcagggtaatcctgcttatcgcggcattgcgggacctattaaccttaacacgatttacttcttcgaggatgtaagcaccggactggtaccgttatccgaactgggtcgggcagtgaatgtgcctaccccacttatcgatgctgttcttgacttgatcagttcgctgatagacacggatttcagaaaggaaggtcgtaccttggaaaaattaggtctgagcggacttaccgccgcgggcataagaagtgctgttgag

SEQ ID NO: 56 - protein, 359 aa, Artificial Sequence
  Engineered variant of opine dehydrogenase CENDH
MIESKTYAVLGLGNGGHAFAAYLALKGQSVLAWDIDAQRIKEIQDRGAIIAEGPGLAGTAHPDLLTSDIGLAVKDADVILIVVPAIHHASIAANIASYISEGQLIILNPGATGGALEFRKILRENGAPEVTIGETSSMLFTCRSERPGQVTVNAIKGAMDFACLPAAKAGWALEQIGSVLPQYVAVENVLHTSLTNVNAVMHPLPTLLNAARCESGTPFQYYLEGITPSVGSLAEKVDAERIAIAKAFDLNVPSVCEWYKESYGQSPATIYEAVQGNPAYRGIAGPINLNTIYFFEDVSTGLVPLSELGRAVNVPTPLIDAVLDLISSLIDTDFRKEGRTLEKLGLSGLTAAGIRSAVE

SEQ ID NO: 57 - DNA, 1077 bp, Artificial Sequence
  Engineered variant of opine dehydrogenase CENDH
atgatcgagtcaaaaacatacgccgttttgggattaggaaacgggggtcacgcatttgccgcctatttagcattgaagggccagagtgtactggcttgggacatcgatgctcagagaatcaaagagattcaggaccgtggagccatcatagcggaaggaccaggacttgctgggactgctcacccggatcttctgacctcagatataggtttggcggttaaagacgctgatgtgatactgattgtagtgccggccatccaccacgcttccattgcagcaaatatcgccagttacatttccgagggtcagttgattatccttaaccctggggcaacgggtggagcgctggaattccggaaaatcctgcgtgaaaatggtgcgccggaggtaacgatcggggaaacctcaagtatgctctttacatgccgctccgagagaccaggacaggttacggtaaatgcgataaaaggcgccatggactttgcatgtctcccagcggcaaaagctggatgggccctggaacagatagggtcggttcttcctcaatacgtggctgtcgaaaacgtgttgcatacttcgctgactaatgtgaacgctgtaatgcacccgctgccaacactgttaaacgctgctcgttgtgagtctggtaccccattccaatattatctggaggggattacgccatcagtcgggagtcttgcggagaaagtggacgctgaacgcatagcaatcgcaaaggctttcgatttaaacgttccgtcggtctgcgaatggtacaaggaaagttacggccagtcaccggccacaatttatgaagcggtgcagggtaatcctgcttatcgcggcattgcgggacctattaaccttaacacggtgtacttcttcgaggatgtaagcaccggactggtaccgttatccgaactgggtcgggcagtgaatgtgcctaccccacttatcgatgctgttcttgacttgatcagttcgctgatagacacggatttcagaaaggaaggtcgtaccttggaaaaattaggtctgagcggacttaccgccgcgggcataagaagtgctgttgag

SEQ ID NO: 58 - protein, 359 aa, Artificial Sequence
  Engineered variant of opine dehydrogenase CENDH
MIESKTYAVLGLGNGGHAFAAYLALKGQSVLAWDIDAQRIKEIQDRGAIIAEGPGLAGTAHPDLLTSDIGLAVKDADVILIVVPAIHHASIAANIASYISEGQLIILNPGATGGALEFRKILRENGAPEVTIGETSSMLFTCRSERPGQVTVNAIKGAMDFACLPAAKAGWALEQIGSVLPQYVAVENVLHTSLTNVNAVMHPLPTLLNAARCESGTPFQYYLEGITPSVGSLAEKVDAERIAIAKAFDLNVPSVCEWYKESYGQSPATIYEAVQGNPAYRGIAGPINLNTVYFFEDVSTGLVPLSELGRAVNVPTPLIDAVLDLISSLIDTDFRKEGRTLEKLGLSGLTAAGIRSAVE

SEQ ID NO: 59 - DNA, 1077 bp, Artificial Sequence
  Engineered variant of opine dehydrogenase CENDH
atgatcgagtcaaaaacatacgccgttttgggattaggaaacgggggtcacgcatttgccgcctatttagcattgaagggccagagtgtactggcttgggacatcgatgctcagagaatcaaagagattcaggaccgtggagccatcatagcggaaggaccaggacttgctgggactgctcacccggatcttctgacctcagatataggtttggcggttaaagacgctgatgtgatactgattgtagtgccggccatccaccacgcttccattgcagcaaatatcgccagttacatttccgagggtcagttgattatccttaaccctggggcaacgggtggagcgctggaattccggaaaatcctgcgtgaaaatggtgcgccggaggtaacgatcggggaaacctcaagtatgctctttacatgccgctccgagagaccaggacaggttacggtaaatgcgataaaaggcgccatggactttgcatgtctcccagcggcaaaagctggatgggccctggaacagatagggtcggttcttcctcaatacgtggctgtcgaaaacgtgttgcatacttcgctgactaatgtgaacgctgtaatgcacccgctgccaacactgttaaacgctgctcgttgtgagtctggtaccccattccaatattatctggaggggattacgccatcagtcgggagtcttgcggagaaagtggacgctgaacgcatagcaatcgcaaaggctttcgatttaaacgttccgtcggtctgcgaatggtacaaggaaagttacggccagtcaccggccacaatttatgaagcggtgcagggtaatcctgcttatcgcggcattgcgggacctattaaccttaacacgcgcgttttcttcgaggatgtaagcaccggactggtaccgttatccgaactgggtcgggcagtgaatgtgcctaccccacttatcgatgctgttcttgacttgatcagttcgctgatagacacggatttcagaaaggaaggtcgtaccttggaaaaattaggtctgagcggacttaccgccgcgggcataagaagtgctgttgag

SEQ ID NO: 60 - protein, 359 aa, Artificial Sequence
  Engineered variant of opine dehydrogenase CENDH
MIESKTYAVLGLGNGGHAFAAYLALKGQSVLAWDIDAQRIKEIQDRGAIIAEGPGLAGTAHPDLLTSDIGLAVKDADVILIVVPAIHHASIAANIASYISEGQLIILNPGATGGALEFRKILRENGAPEVTIGETSSMLFTCRSERPGQVTVNAIKGAMDFACLPAAKAGWALEQIGSVLPQYVAVENVLHTSLTNVNAVMHPLPTLLNAARCESGTPFQYYLEGITPSVGSLAEKVDAERIAIAKAFDLNVPSVCEWYKESYGQSPATIYEAVQGNPAYRGIAGPINLNTRVFFEDVSTGLVPLSELGRAVNVPTPLIDAVLDLISSLIDTDFRKEGRTLEKLGLSGLTAAGIRSAVE

SEQ ID NO: 61 - DNA, 1077 bp, Artificial Sequence
  Engineered variant of opine dehydrogenase CENDH
atgatcgagtcaaaaacatacgccgttttgggattaggaaacgggggtcacgcatttgccgcctatttagcattgaagggccagagtgtactggcttgggacatcgatgctcagagaatcaaagagattcaggaccgtggagccatcatagcggaaggaccaggacttgctgggactgctcacccggatcttctgacctcagatataggtttggcggttaaagacgctgatgtgatactgattgtagtgccggccatccaccacgcttccattgcagcaaatatcgccagttacatttccgagggtcagttgattatccttaaccctggggcaacgggtggagcgctggaattccggaaaatcctgcgtgaaaatggtgcgccggaggtaacgatcggggaaacctcaagtatgctctttacatgccgctccgagagaccaggacaggttacggtaaatgcgataaaaggcgccatggactttgcatgtctcccagcggcaaaagctggatgggccctggaacagatagggtcggttcttcctcaatacgtggctgtcgaaaacgtgttgcatacttcgctgactaatgtgaacgctgtaatgcacccgctgccaacactgttaaacgctgctcgttgtgagtctggtaccccattccaatattatctggaggggattacgccatcagtcgggagtcttgcggagaaagtggacgctgaacgcatagcaatcgcaaaggctttcgatttaaacgttccgtcggtctgcgaatggtacaaggaaagttacggccagtcaccggccacaatttatgaagcggtgcagggtaatcctgcttatcgcggcattgcgggacctattaaccttaacacgacttacttcttcgaggatgtaagcaccggactggtaccgttatccgaactgggtcgggcagtgaatgtgcctaccccacttatcgatgctgttcttgacttgatcagttcgctgatagacacggatttcagaaaggaaggtcgtaccttggaaaaattaggtctgagcggacttaccgccgcgggcataagaagtgctgttgag

SEQ ID NO: 62 - protein, 359 aa, Artificial Sequence
  Engineered variant of opine dehydrogenase CENDH
MIESKTYAVLGLGNGGHAFAAYLALKGQSVLAWDIDAQRIKEIQDRGAIIAEGPGLAGTAHPDLLTSDIGLAVKDADVILIVVPAIHHASIAANIASYISEGQLIILNPGATGGALEFRKILRENGAPEVTIGETSSMLFTCRSERPGQVTVNAIKGAMDFACLPAAKAGWALEQIGSVLPQYVAVENVLHTSLTNVNAVMHPLPTLLNAARCESGTPFQYYLEGITPSVGSLAEKVDAERIAIAKAFDLNVPSVCEWYKESYGQSPATIYEAVQGNPAYRGIAGPINLNTTYFFEDVSTGLVPLSELGRAVNVPTPLIDAVLDLISSLIDTDFRKEGRTLEKLGLSGLTAAGIRSAVE

SEQ ID NO: 63 - DNA, 1077 bp, Artificial Sequence
  Engineered variant of opine dehydrogenase CENDH
atgatcgagtcaaaaacatacgccgttttgggattaggaaacgggggtcacgcatttgccgcctatttagcattgaagggccagagtgtactggcttgggacatcgatgctcagagaatcaaagagattcaggaccgtggagccatcatagcggaaggaccaggacttgctgggactgctcacccggatcttctgacctcagatataggtttggcggttaaagacgctgatgtgatactgattgtagtgccggccatccaccacgcttccattgcagcaaatatcgccagttacatttccgagggtcagttgattatccttaaccctggggcaacgggtggagcgctggaattccggaaaatcctgcgtgaaaatggtgcgccggaggtaacgatcggggaaacctcaagtatgctctttacatgccgctccgagagaccaggacaggttacggtaaatgcgataaaaggcgccatggactttgcatgtctcccagcggcaaaagctggatgggccctggaacagatagggtcggttcttcctcaatacgtggctgtcgaaaacgtgttgcatacttcgctgactaatgtgaacgctgtaatgcacccgctgccaacactgttaaacgctgctcgttgtgagtctggtaccccattccaatattatctggaggggattacgccatcagtcgggagtcttgcggagaaagtggacgctgaacgcatagcaatcgcaaaggctttcgatttaaacgttccgtcggtctgcgaatggtacaaggaaagttacggccagtcaccggccacaatttatgaagcggtgcagggtaatcctgcttatcgcggcattgcgggacctattaaccttaacacgcgccatttcttcgaggatgtaagcaccggactggtaccgttatccgaactgggtcgggcagtgaatgtgcctaccccacttatcgatgctgttcttgacttgatcagttcgctgatagacacggatttcagaaaggaaggtcgtaccttggaaaaattaggtctgagcggacttaccgccgcgggcataagaagtgctgttgag

SEQ ID NO: 64 - protein, 359 aa, Artificial Sequence
  Engineered variant of opine dehydrogenase CENDH
MIESKTYAVLGLGNGGHAFAAYLALKGQSVLAWDIDAQRIKEIQDRGAIIAEGPGLAGTAHPDLLTSDIGLAVKDADVILIVVPAIHHASIAANIASYISEGQLIILNPGATGGALEFRKILRENGAPEVTIGETSSMLFTCRSERPGQVTVNAIKGAMDFACLPAAKAGWALEQIGSVLPQYVAVENVLHTSLTNVNAVMHPLPTLLNAARCESGTPFQYYLEGITPSVGSLAEKVDAERIAIAKAFDLNVPSVCEWYKESYGQSPATIYEAVQGNPAYRGIAGPINLNTRHFFEDVSTGLVPLSELGRAVNVPTPLIDAVLDLISSLIDTDFRKEGRTLEKLGLSGLTAAGIRSAVE

SEQ ID NO: 65 - DNA, 1077 bp, Artificial Sequence
  Engineered variant of opine dehydrogenase CENDH
atgatcgagtcaaaaacatacgccgttttgggattaggaaacgggggtcacgcatttgccgcctatttagcattgaagggccagagtgtactggcttgggacatcgatgctcagagaatcaaagagattcaggaccgtggagccatcatagcggaaggaccaggacttgctgggactgctcacccggatcttctgacctcagatataggtttggcggttaaagacgctgatgtgatactgattgtagtgccggccatccaccacgcttccattgcagcaaatatcgccagttacatttccgagggtcagttgattatccttaaccctggggcaacgggtggagcgctggaattccggaaaatcctgcgtgaaaatggtgcgccggaggtaacgatcggggaaacctcaagtatgctctttacatgccgctccgagagaccaggacaggttacggtaaatgcgataaaaggcgccatggactttgcatgtctcccagcggcaaaagctggatgggccctggaacagatagggtcggttcttcctcaatacgtggctgtcgaaaacgtgttgcatacttcgctgactaatgtgaacgctgtaatgcacccgctgccaacactgttaaacgctgctcgttgtgagtctggtaccccattccaatattatctggaggggattacgccatcagtcgggagtcttgcggagaaagtggacgctgaacgcatagcaatcgcaaaggctttcgatttaaacgttccgtcggtctgcgaatggtacaaggaaagttacggccagtcaccggccacaatttatgaagcggtgcagggtaatcctgcttatcgcggcattgcgggacctattaaccttaacacggggtacttcttcgaggatgtaagcaccggactggtaccgttatccgaactgggtcgggcagtgaatgtgcctaccccacttatcgatgctgttcttgacttgatcagttcgctgatagacacggatttcagaaaggaaggtcgtaccttggaaaaattaggtctgagcggacttaccgccgcgggcataagaagtgctgttgag

SEQ ID NO: 66 - protein, 359 aa, Artificial Sequence
  Engineered variant of opine dehydrogenase CENDH
MIESKTYAVLGLGNGGHAFAAYLALKGQSVLAWDIDAQRIKEIQDRGAIIAEGPGLAGTAHPDLLTSDIGLAVKDADVILIVVPAIHHASIAANIASYISEGQLIILNPGATGGALEFRKILRENGAPEVTIGETSSMLFTCRSERPGQVTVNAIKGAMDFACLPAAKAGWALEQIGSVLPQYVAVENVLHTSLTNVNAVMHPLPTLLNAARCESGTPFQYYLEGITPSVGSLAEKVDAERIAIAKAFDLNVPSVCEWYKESYGQSPATIYEAVQGNPAYRGIAGPINLNTGYFFEDVSTGLVPLSELGRAVNVPTPLIDAVLDLISSLIDTDFRKEGRTLEKLGLSGLTAAGIRSAVE

SEQ ID NO: 67 - DNA, 1077 bp, Artificial Sequence
  Engineered variant of opine dehydrogenase CENDH
atgatcgagtcaaaaacatacgccgttttgggattaggaaacgggggtcacgcatttgccgcctatttagcattgaagggccagagtgtactggcttgggacatcgatgctcagagaatcaaagagattcaggaccgtggagccatcatagcggaaggaccaggacttgctgggactgctcacccggatcttctgacctcagatataggtttggcggttaaagacgctgatgtgatactgattgtagtgccggccatccaccacgcttccattgcagcaaatatcgccagttacatttccgagggtcagttgattatccttaaccctggggcaacgggtggagcgctggaattccggaaaatcctgcgtgaaaatggtgcgccggaggtaacgatcggggaaacctcaagtatgctctttacatgccgctccgagagaccaggacaggttacggtaaatgcgataaaaggcgccatggactttgcatgtctcccagcggcaaaagctggatgggccctggaacagatagggtcggttcttcctcaatacgtggctgtcgaaaacgtgttgcatacttcgctgactaatgtgaacgctgtaatgcacccgctgccaacactgttaaacgctgctcgttgtgagtctggtaccccattccaatattatctggaggggattacgccatcagtcgggagtcttgcggagaaagtggacgctgaacgcatagcaatcgcaaaggctttcgatttaaacgttccgtcggtctgcgaatggtacaaggaaagttacggccagtcaccggccacaatttatgaagcggtgcagggtaatcctgcttatcgcggcattgcgggacctattaaccttaacacgccgtacttcttcgaggatgtaagcaccggactggtaccgttatccgaactgggtcgggcagtgaatgtgcctaccccacttatcgatgctgttcttgacttgatcagttcgctgatagacacggatttcagaaaggaaggtcgtaccttggaaaaattaggtctgagcggacttaccgccgcgggcataagaagtgctgttgag

SEQ ID NO: 68 - protein, 359 aa, Artificial Sequence
  Engineered variant of opine dehydrogenase CENDH
MIESKTYAVLGLGNGGHAFAAYLALKGQSVLAWDIDAQRIKEIQDRGAIIAEGPGLAGTAHPDLLTSDIGLAVKDADVILIVVPAIHHASIAANIASYISEGQLIILNPGATGGALEFRKILRENGAPEVTIGETSSMLFTCRSERPGQVTVNAIKGAMDFACLPAAKAGWALEQIGSVLPQYVAVENVLHTSLTNVNAVMHPLPTLLNAARCESGTPFQYYLEGITPSVGSLAEKVDAERIAIAKAFDLNVPSVCEWYKESYGQSPATIYEAVQGNPAYRGIAGPINLNTPYFFEDVSTGLVPLSELGRAVNVPTPLIDAVLDLISSLIDTDFRKEGRTLEKLGLSGLTAAGIRSAVE

SEQ ID NO: 69 - DNA, 1077 bp, Artificial Sequence
  Engineered variant of opine dehydrogenase CENDH
atgatcgagtcaaaaacatacgccgttttgggattaggaaacgggggtcacgcatttgccgcctatttagcattgaagggccagagtgtactggcttgggacatcgatgctcagagaatcaaagagattcaggaccgtggagccatcatagcggaaggaccaggacttgctgggactgctcacccggatcttctgacctcagatataggtttggcggttaaagacgctgatgtgatactgattgtagtgccggccatccaccacgcttccattgcagcaaatatcgccagttacatttccgagggtcagttgattatccttaaccctggggcaacgggtggagcgctggaattccggaaaatcctgcgtgaaaatggtgcgccggaggtaacgatcggggaaacctcaagtatgctctttacatgccgctccgagagaccaggacaggttacggtaaatgcgataaaaggcgccatggactttgcatgtctcccagcggcaaaagctggatgggccctggaacagatagggtcggttcttcctcaatacgtggctgtcgaaaacgtgttgcatacttcgctgactaatgtgaacgctgtaatgcacccgctgccaacactgttaaacgctgctcgttgtgagtctggtaccccattccaatattatctggaggggattacgccatcagtcgggagtcttgcggagaaagtggacgctgaacgcatagcaatcgcaaaggctttcgatttaaacgttccgtcggtctgcgaatggtacaaggaaagttacggccagtcaccggccacaatttatgaagcggtgcagggtaatcctgcttatcgcggcattgcgggacctattaaccttaacacgtgttacttcttcgaggatgtaagcaccggactggtaccgttatccgaactgggtcgggcagtgaatgtgcctaccccacttatcgatgctgttcttgacttgatcagttcgctgatagacacggatttcagaaaggaaggtcgtaccttggaaaaattaggtctgagcggacttaccgccgcgggcataagaagtgctgttgag

SEQ ID NO: 70 - protein, 359 aa, Artificial Sequence
  Engineered variant of opine dehydrogenase CENDH
MIESKTYAVLGLGNGGHAFAAYLALKGQSVLAWDIDAQRIKEIQDRGAIIAEGPGLAGTAHPDLLTSDIGLAVKDADVILIVVPAIHHASIAANIASYISEGQLIILNPGATGGALEFRKILRENGAPEVTIGETSSMLFTCRSERPGQVTVNAIKGAMDFACLPAAKAGWALEQIGSVLPQYVAVENVLHTSLTNVNAVMHPLPTLLNAARCESGTPFQYYLEGITPSVGSLAEKVDAERIAIAKAFDLNVPSVCEWYKESYGQSPATIYEAVQGNPAYRGIAGPINLNTCYFFEDVSTGLVPLSELGRAVNVPTPLIDAVLDLISSLIDTDFRKEGRTLEKLGLSGLTAAGIRSAVE

SEQ ID NO: 71 - DNA, 1077 bp, Artificial Sequence
  Engineered variant of opine dehydrogenase CENDH
atgatcgagtcaaaaacatacgccgttttgggattaggaaacgggggtcacgcatttgccgcctatttagcattgaagggccagagtgtactggcttgggacatcgatgctcagagaatcaaagagattcaggaccgtggagccatcatagcggaaggaccaggacttgctgggactgctcacccggatcttctgacctcagatataggtttggcggttaaagacgctgatgtgatactgattgtagtgccggccatccaccacgcttccattgcagcaaatatcgccagttacatttccgagggtcagttgattatccttaaccctggggcaacgggtggagcgctggaattccggaaaatcctgcgtgaaaatggtgcgccggaggtaacgatcggggaaacctcaagtatgctctttacatgccgctccgagagaccaggacaggttacggtaaatgcgataaaaggcgccatggactttgcatgtctcccagcggcaaaagctggatgggccctggaacagatagggtcggttcttcctcaatacgtggctgtcgaaaacgtgttgcatacttcgctgactaatgtgaacgctgtaatgcacccgctgccaacactgttaaacgctgctcgttgtgagtctggtaccccattccaatattatctggaggggattacgccatcagtcgggagtcttgcggagaaagtggacgctgaacgcatagcaatcgcaaaggctttcgatttaaacgttccgtcggtctgcgaatggtacaaggaaagttacggccagtcaccggccacaatttatgaagcggtgcagggtaatcctgcttatcgcggcattgcgggacctattaaccttaacacgtattacttcttcgaggatgtaagcaccggactggtaccgttatccgaactgggtcgggcagtgaatgtgcctaccccacttatcgatgctgttcttgacttgatcagttcgctgatagacacggatttcagaaaggaaggtcgtaccttggaaaaattaggtctgagcggacttaccgccgcgggcataagaagtgctgttgag

SEQ ID NO: 72 - protein, 359 aa, Artificial Sequence
  Engineered variant of opine dehydrogenase CENDH
MIESKTYAVLGLGNGGHAFAAYLALKGQSVLAWDIDAQRIKEIQDRGAIIAEGPGLAGTAHPDLLTSDIGLAVKDADVILIVVPAIHHASIAANIASYISEGQLIILNPGATGGALEFRKILRENGAPEVTIGETSSMLFTCRSERPGQVTVNAIKGAMDFACLPAAKAGWALEQIGSVLPQYVAVENVLHTSLTNVNAVMHPLPTLLNAARCESGTPFQYYLEGITPSVGSLAEKVDAERIAIAKAFDLNVPSVCEWYKESYGQSPATIYEAVQGNPAYRGIAGPINLNTYYFFEDVSTGLVPLSELGRAVNVPTPLIDAVLDLISSLIDTDFRKEGRTLEKLGLSGLTAAGIRSAVE

SEQ ID NO: 73 - DNA, 1077 bp, Artificial Sequence
  Engineered variant of opine dehydrogenase CENDH
atgatcgagtcaaaaacatacgccgttttgggattaggaaacgggggtcacgcatttgccgcctatttagcattgaagggccagagtgtactggcttgggacatcgatgctcagagaatcaaagagattcaggaccgtggagccatcatagcggaaggaccaggacttgctgggactgctcacccggatcttctgacctcagatataggtttggcggttaaagacgctgatgtgatactgattgtagtgccggccatccaccacgcttccattgcagcaaatatcgccagttacatttccgagggtcagttgattatccttaaccctggggcaacgggtggagcgctggaattccggaaaatcctgcgtgaaaatggtgcgccggaggtaacgatcggggaaacctcaagtatgctctttacatgccgctccgagagaccaggacaggttacggtaaatgcgataaaaggcgccatggactttgcatgtctcccagcggcaaaagctggatgggccctggaacagatagggtcggttcttcctcaatacgtggctgtcgaaaacgtgttgcatacttcgctgactaatgtgaacgctgtaatgcacccgctgccaacactgttaaacgctgctcgttgtgagtctggtaccccattccaatattatctggaggggattacgccatcagtcgggagtcttgcggagaaagtggacgctgaacgcatagcaatcgcaaaggctttcgatttaaacgttccgtcggtctgcgaatggtacaaggaaagttacggccagtcaccggccacaatttatgaagcggtgcagggtaatcctgcttatcgcggcattgcgggacctattaaccttaacacgtcgtacttcttcgaggatgtaagcaccggactggtaccgttatccgaactgggtcgggcagtgaatgtgcctaccccacttatcgatgctgttcttgacttgatcagttcgctgatagacacggatttcagaaaggaaggtcgtaccttggaaaaattaggtctgagcggacttaccgccgcgggcataagaagtgctgttgag

SEQ ID NO: 74 - protein, 359 aa, Artificial Sequence
  Engineered variant of opine dehydrogenase CENDH
MIESKTYAVLGLGNGGHAFAAYLALKGQSVLAWDIDAQRIKEIQDRGAIIAEGPGLAGTAHPDLLTSDIGLAVKDADVILIVVPAIHHASIAANIASYISEGQLIILNPGATGGALEFRKILRENGAPEVTIGETSSMLFTCRSERPGQVTVNAIKGAMDFACLPAAKAGWALEQIGSVLPQYVAVENVLHTSLTNVNAVMHPLPTLLNAARCESGTPFQYYLEGITPSVGSLAEKVDAERIAIAKAFDLNVPSVCEWYKESYGQSPATIYEAVQGNPAYRGIAGPINLNTSYFFEDVSTGLVPLSELGRAVNVPTPLIDAVLDLISSLIDTDFRKEGRTLEKLGLSGLTAAGIRSAVE

SEQ ID NO: 75 - DNA, 1077 bp, Artificial Sequence
  Engineered variant of opine dehydrogenase CENDH
atgatcgagtcaaaaacatacgccgttttgggattaggaaacgggggtcacgcatttgccgcctatttagcattgaagggccagagtgtactggcttgggacatcgatgctcagagaatcaaagagattcaggaccgtggagccatcatagcggaaggaccaggacttgctgggactgctcacccggatcttctgacctcagatataggtttggcggttaaagacgctgatgtgatactgattgtagtgccggccatccaccacgcttccattgcagcaaatatcgccagttacatttccgagggtcagttgattatccttaaccctggggcaacgggtggagcgctggaattccggaaaatcctgcgtgaaaatggtgcgccggaggtaacgatcggggaaacctcaagtatgctctttacatgccgctccgagagaccaggacaggttacggtaaatgcgataaaaggcgccatggactttgcatgtctcccagcggcaaaagctggatgggccctggaacagatagggtcggttcttcctcaatacgtggctgtcgaaaacgtgttgcatacttcgctgactaatgtgaacgctgtaatgcacccgctgccaacactgttaaacgctgctcgttgtgagtctggtaccccattccaatattatctggaggggattacgccatcagtcgggagtcttgcggagaaagtggacgctgaacgcatagcaatcgcaaaggctttcgatttaaacgttccgtcggtctgcgaatggtacaaggaaagttacggccagtcaccggccacaatttatgaagcggtgcagggtaatcctgcttatcgcggcattgcgggacctattaaccttaacacgcgcattttcttcgaggatgtaagcaccggactggtaccgttatccgaactgggtcgggcagtgaatgtgcctaccccacttatcgatgctgttcttgacttgatcagttcgctgatagacacggatttcagaaaggaaggtcgtaccttggaaaaattaggtctgagcggacttaccgccgcgggcataagaagtgctgttgag

SEQ ID NO: 76 - protein, 359 aa, Artificial Sequence
  Engineered variant of opine dehydrogenase CENDH
MIESKTYAVLGLGNGGHAFAAYLALKGQSVLAWDIDAQRIKEIQDRGAIIAEGPGLAGTAHPDLLTSDIGLAVKDADVILIVVPAIHHASIAANIASYISEGQLIILNPGATGGALEFRKILRENGAPEVTIGETSSMLFTCRSERPGQVTVNAIKGAMDFACLPAAKAGWALEQIGSVLPQYVAVENVLHTSLTNVNAVMHPLPTLLNAARCESGTPFQYYLEGITPSVGSLAEKVDAERIAIAKAFDLNVPSVCEWYKESYGQSPATIYEAVQGNPAYRGIAGPINLNTRIFFEDVSTGLVPLSELGRAVNVPTPLIDAVLDLISSLIDTDFRKEGRTLEKLGLSGLTAAGIRSAVE

SEQ ID NO: 77 - DNA, 1077 bp, Artificial Sequence
  Engineered variant of opine dehydrogenase CENDH
atgatcgagtcaaaaacatacgccgttttgggattaggaaacgggggtcacgcatttgccgcctatttagcattgaagggccagagtgtactggcttgggacatcgatgctcagagaatcaaagagattcaggaccgtggagccatcatagcggaaggaccaggacttgctgggactgctcacccggatcttctgacctcagatataggtttggcggttaaagacgctgatgtgatactgattgtagtgccggccatccaccacgcttccattgcagcaaatatcgccagttacatttccgagggtcagttgattatccttaaccctgggatgacgggtggagcgctggaattccggaaaatcctgcgtgaaaatggtgcgccggaggtaacgatcggggaaacctcaagtatgctctttacatgccgctccgagagaccaggacaggttacggtaaatgcgataaaaggcgccatggactttgcatgtctcccagcggcaaaagctggatgggccctggaacagatagggtcggttcttcctcaatacgtggctgtcgaaaacgtgttgcatacttcgctgactaatgtgaacgctgtaatgcacccgctgccaacactgttaaacgctgctcgttgtgagtctggtaccccattccaatattatctggaggggattacgccatcagtcgggagtcttgcggagaaagtggacgctgaacgcatagcaatcgcaaaggctttcgatttaaacgttccgtcggtctgcgaatggtacaaggaaagttacggccagtcaccggccacaatttatgaagcggtgcagggtaatcctgcttatcgcggcattgcgggacctattaaccttaacacgcgctacttcttcgaggatgtaagcaccggactggtaccgttatccgaactgggtcgggcagtgaatgtgcctaccccacttatcgatgctgttcttgacttgatcagttcgctgatagacacggatttcagaaaggaaggtcgtaccttggaaaaattaggtctgagcggacttaccgccgcgggcataagaagtgctgttgag

SEQ ID NO: 78 - protein, 359 aa, Artificial Sequence
  Engineered variant of opine dehydrogenase CENDH
MIESKTYAVLGLGNGGHAFAAYLALKGQSVLAWDIDAQRIKEIQDRGAIIAEGPGLAGTAHPDLLTSDIGLAVKDADVILIVVPAIHHASIAANIASYISEGQLIILNPGMTGGALEFRKILRENGAPEVTIGETSSMLFTCRSERPGQVTVNAIKGAMDFACLPAAKAGWALEQIGSVLPQYVAVENVLHTSLTNVNAVMHPLPTLLNAARCESGTPFQYYLEGITPSVGSLAEKVDAERIAIAKAFDLNVPSVCEWYKESYGQSPATIYEAVQGNPAYRGIAGPINLNTRYFFEDVSTGLVPLSELGRAVNVPTPLIDAVLDLISSLIDTDFRKEGRTLEKLGLSGLTAAGIRSAVE

SEQ ID NO: 79 - DNA, 1077 bp, Artificial Sequence
  Engineered variant of opine dehydrogenase CENDH
atgatcgagtcaaaaacatacgccgttttgggattaggaaacgggggtcacgcatttgccgcctatttagcattgaagggccagagtgtactggcttgggacatcgatgctcagagaatcaaagagattcaggaccgtggagccatcatagcggaaggaccaggacttgctgggactgctcacccggatcttctgacctcagatataggtttggcggttaaagacgctgatgtgatactgattgtagtgccggccatccaccacgcttccattgcagcaaatatcgccagttacatttccgagggtcagttgattatccttaaccctggggcaacgggtggagcgctggaattccggaaaatcctgcgtgaaaatggtgcgccggaggtaacgatcggggaaacctcaagtatgctctttacatgccgctccgagagaccaggacaggttacggtaaatgcgataaaaggcgccatggactttgcatgtctcccagcggcaaaagctggatgggccctggaacagatagggtcggttcttcctcaatacgtggctgtcgaaaacgtgttgcatacttcgctgactaatgtgaacgctgtaatgcacccgctgccaacactgttaaacgctgctcgttgtgagtctggtaccccattccaatattatctggaggggattacgccatcagtcgggagtcttgcggagaaagtggacgctgaacgcatagcaatcgcaaaggctttcgatttaaacgttccgtcggtctgcgaatggtacaaggaaagttacggccagtcaccggccacaatttatgaagcggtgcagggtaatcctgcttatcgcggcattgcgggacctattaaccttaacacgcgcaagttcttcgaggatgtaagcaccggactggtaccgttatccgaactgggtcgggcagtgaatgtgcctaccccacttatcgatgctgttcttgacttgatcagttcgctgatagacacggatttcagaaaggaaggtcgtaccttggaaaaattaggtctgagcggacttaccgccgcgggcataagaagtgctgttgag

SEQ ID NO: 80 - protein, 359 aa, Artificial Sequence
  Engineered variant of opine dehydrogenase CENDH
MIESKTYAVLGLGNGGHAFAAYLALKGQSVLAWDIDAQRIKEIQDRGAIIAEGPGLAGTAHPDLLTSDIGLAVKDADVILIVVPAIHHASIAANIASYISEGQLIILNPGATGGALEFRKILRENGAPEVTIGETSSMLFTCRSERPGQVTVNAIKGAMDFACLPAAKAGWALEQIGSVLPQYVAVENVLHTSLTNVNAVMHPLPTLLNAARCESGTPFQYYLEGITPSVGSLAEKVDAERIAIAKAFDLNVPSVCEWYKESYGQSPATIYEAVQGNPAYRGIAGPINLNTRKFFEDVSTGLVPLSELGRAVNVPTPLIDAVLDLISSLIDTDFRKEGRTLEKLGLSGLTAAGIRSAVE

SEQ ID NO: 81 - DNA, 1077 bp, Artificial Sequence
  Engineered variant of opine dehydrogenase CENDH
atgatcgagtcaaaaacatacgccgttttgggattaggaaacgggggtcacgcatttgccgcctatttagcattgaagggccagagtgtactggcttgggacatcgatgctcagagaatcaaagagattcaggaccgtggagccatcatagcggaaggaccaggacttgctgggactgctcacccggatcttctgacctcagatataggtttggcggttaaagacgctgatgtgatactgattgtagtgccggccatccaccacgcttccattgcagcaaatatcgccagttacatttccgagggtcagttgattatccttaaccctggggcaacgggtggagcgctggaattccggaaaatcctgcgtgaaaatggtgcgccggaggtaacgatcggggaaacctcaagtatgctctttacatgccgctccgagagaccaggacaggttacggtaaatgcgataaaaggcgccatggactttgcatgtctcccagcggcaaaagctggatgggccctggaacagatagggtcggttcttcctcaatacgtggctgtcgaaaacgtgttgcatacttcgctgactaatgtgaacgctgtaatgcacccgctgccaacactgttaaacgctgctcgttgtgagtctggtaccccattccaatattatctggaggggattacgccatcagtcgggagtcttgcggagaaagtggacgctgaacgcatagcaatcgcaaaggctttcgatttaaacgttccgtcggtctgcgaatggtacaaggaaagttacggccagtcaccggccacaatttatgaagcggtgcagggtaatcctgcttatcgcggcattgcgggacctattaaccttaacacgcgcaatttcttcgaggatgtaagcaccggactggtaccgttatccgaactgggtcgggcagtgaatgtgcctaccccacttatcgatgctgttcttgacttgatcagttcgctgatagacacggatttcagaaaggaaggtcgtaccttggaaaaattaggtctgagcggacttaccgccgcgggcataagaagtgctgttgag

SEQ ID NO: 82 - protein, 359 aa, Artificial Sequence
  Engineered variant of opine dehydrogenase CENDH
MIESKTYAVLGLGNGGHAFAAYLALKGQSVLAWDIDAQRIKEIQDRGAIIAEGPGLAGTAHPDLLTSDIGLAVKDADVILIVVPAIHHASIAANIASYISEGQLIILNPGATGGALEFRKILRENGAPEVTIGETSSMLFTCRSERPGQVTVNAIKGAMDFACLPAAKAGWALEQIGSVLPQYVAVENVLHTSLTNVNAVMHPLPTLLNAARCESGTPFQYYLEGITPSVGSLAEKVDAERIAIAKAFDLNVPSVCEWYKESYGQSPATIYEAVQGNPAYRGIAGPINLNTRNFFEDVSTGLVPLSELGRAVNVPTPLIDAVLDLISSLIDTDFRKEGRTLEKLGLSGLTAAGIRSAVE

SEQ ID NO: 83 - DNA, 1077 bp, Artificial Sequence
  Engineered variant of opine dehydrogenase CENDH
atgatcgagtcaaaaacatacgccgttttgggattaggaaacgggggtcacgcatttgccgcctatttagcattgaagggccagagtgtactggcttgggacatcgatgctcagagaatcaaagagattcaggaccgtggagccatcatagcggaaggaccaggacttgctgggactgctcacccggatcttctgacctcagatataggtttggcggttaaagacgctgatgtgatactgattgtagtgccggccatccaccacgcttccattgcagcaaatatcgccagttacatttccgagggtcagttgattatccttaaccctggggcaacgggtggagcgctggaattccggaaaatcctgcgtgaaaatggtgcgccggaggtaacgatcggggaaacctcaagtatgctctttacatgccgctccgagagaccaggacaggttacggtaaatgcgataaaaggcgccatggactttgcatgtctcccagcggcaaaagctggatgggccctggaacagatagggtcggttcttcctcaatacgtggctgtcgaaaacgtgttgcatacttcgctgactaatccgaacgctgtaatgcacccgctgccaacactgttaaacgctgctcgttgtgagtctggtaccccattccaatattatctggaggggattacgccatcagtcgggagtcttgcggagaaagtggacgctgaacgcatagcaatcgcaaaggctttcgatttaaacgttccgtcggtctgcgaatggtacaaggaaagttacggccagtcaccggccacaatttatgaagcggtgcagggtaatcctgcttatcgcggcattgcgggacctattaaccttaacacgcgctacttcttcgaggatgtaagcaccggactggtaccgttatccgaactgggtcgggcagtgaatgtgcctaccccacttatcgatgctgttcttgacttgatcagttcgctgatagacacggatttcagaaaggaaggtcgtaccttggaaaaattaggtctgagcggacttaccgccgcgggcataagaagtgctgttgag

SEQ ID NO: 84 - protein, 359 aa, Artificial Sequence
  Engineered variant of opine dehydrogenase CENDH
MIESKTYAVLGLGNGGHAFAAYLALKGQSVLAWDIDAQRIKEIQDRGAIIAEGPGLAGTAHPDLLTSDIGLAVKDADVILIVVPAIHHASIAANIASYISEGQLIILNPGATGGALEFRKILRENGAPEVTIGETSSMLFTCRSERPGQVTVNAIKGAMDFACLPAAKAGWALEQIGSVLPQYVAVENVLHTSLTNPNAVMHPLPTLLNAARCESGTPFQYYLEGITPSVGSLAEKVDAERIAIAKAFDLNVPSVCEWYKESYGQSPATIYEAVQGNPAYRGIAGPINLNTRYFFEDVSTGLVPLSELGRAVNVPTPLIDAVLDLISSLIDTDFRKEGRTLEKLGLSGLTAAGIRSAVE

SEQ ID NO: 85 - DNA, 1077 bp, Artificial Sequence
  Engineered variant of opine dehydrogenase CENDH
atgatcgagtcaaaaacatacgccgttttgggattaggaaacgggggtcacgcatttgccgcctatttagcattgaagggccagagtgtactggcttgggacatcgatgctcagagaatcaaagagattcaggaccgtggagccatcatagcggaaggaccaggacttgctgggactgctcacccggatcttctgacctcagatataggtttggcggttaaagacgctgatgtgatactgattgtagtgccggccatccaccacgcttccattgcagcaaatatcgccagttacatttccgagggtcagttgattatccttaaccctggggcaacgggtggagcgctggaattccggaaaatcctgcgtgaaaatggtgcgccggaggtaacgatcggggaaacctcaagtatgctctttacatgccgctccgagagaccaggacaggttacggtaaatgcgataaaaggcgccatggactttgcatgtctcccagcggcaaaagctggatgggccctggaacagatagggtcggttcttcctcaatacgtggctgtcgaaaacgtgttgcatacttcgctgactaatgtggaggctgtaatgcacccgctgccaacactgttaaacgctgctcgttgtgagtctggtaccccattccaatattatctggaggggattacgccatcagtcgggagtcttgcggagaaagtggacgctgaacgcatagcaatcgcaaaggctttcgatttaaacgttccgtcggtctgcgaatggtacaaggaaagttacggccagtcaccggccacaatttatgaagcggtgcagggtaatcctgcttatcgcggcattgcgggacctattaaccttaacacgcgctacttcttcgaggatgtaagcaccggactggtaccgttatccgaactgggtcgggcagtgaatgtgcctaccccacttatcgatgctgttcttgacttgatcagttcgctgatagacacggatttcagaaaggaaggtcgtaccttggaaaaattaggtctgagcggacttaccgccgcgggcataagaagtgctgttgag

SEQ ID NO: 86 - protein, 359 aa, Artificial Sequence
  Engineered variant of opine dehydrogenase CENDH
MIESKTYAVLGLGNGGHAFAAYLALKGQSVLAWDIDAQRIKEIQDRGAIIAEGPGLAGTAHPDLLTSDIGLAVKDADVILIVVPAIHHASIAANIASYISEGQLIILNPGATGGALEFRKILRENGAPEVTIGETSSMLFTCRSERPGQVTVNAIKGAMDFACLPAAKAGWALEQIGSVLPQYVAVENVLHTSLTNVEAVMHPLPTLLNAARCESGTPFQYYLEGITPSVGSLAEKVDAERIAIAKAFDLNVPSVCEWYKESYGQSPATIYEAVQGNPAYRGIAGPINLNTRYFFEDVSTGLVPLSELGRAVNVPTPLIDAVLDLISSLIDTDFRKEGRTLEKLGLSGLTAAGIRSAVE

SEQ ID NO: 87 - DNA, 1077 bp, Artificial Sequence
  Engineered variant of opine dehydrogenase CENDH
atgatcgagtcaaaaacatacgccgttttgggattaggaaacgggggtcacgcatttgccgcctatttagcattgaagggccagagtgtactggcttgggacatcgatgctcagagaatcaaagagattcaggaccgtggagccatcatagcggaaggaccaggacttgctgggactgctcacccggatcttctgacctcagatataggtttggcggttaaagacgctgatgtgatactgattgtagtgccggccatccaccacgcttccattgcagcaaatatcgccagttacatttccgagggtcagttgattatccttaaccctgggatgacgggtggagcgctggaattccggaaaatcctgcgtgaaaatggtgcgccggaggtaacgatcggggaaacctcaagtatgctctttacatgccgctccgagagaccaggacaggttacggtaaatgcgataacaggcgccatggactttgcatgtctcccagcggcaaaagctggatgggccctggaacagatagggtcggttcttcctcaatacgtggctgtcgaaaacgtgttgcatacttcgctgactaatgtgcatgctgtaatgcacccgctgccaacactgttaaacgctgctcgttgtgagtctggtaccccattccaatattatctggaggggattacgccatcagtcgggagtcttgcggagaaagtggacgctgaacgcatagcaatcgcaaaggctttcgatttaaacgttccgtcggtctgcgaatggatgaaggaaagttacggccagtcaccggccacaatttatgaagcggtgcagggtaatcctgctctgcgcggcattgcgggacctattaaccttaacacggtgcacttcttcgaggatgtaagcaccggactggtaccgttatccgaactgggtcgggcagtgaatgtgcctaccccacttatcgatgctgttcttgacttgatcagttcgctgatagacacggatttcagaaaggaaggtcgtaccttggaaaaattaggtctgagcggacttaccgccgcgggcataagaagtgctgttgag

SEQ ID NO: 88 - protein, 359 aa, Artificial Sequence
  Engineered variant of opine dehydrogenase CENDH
MIESKTYAVLGLGNGGHAFAAYLALKGQSVLAWDIDAQRIKEIQDRGAIIAEGPGLAGTAHPDLLTSDIGLAVKDADVILIVVPAIHHASIAANIASYISEGQLIILNPGMTGGALEFRKILRENGAPEVTIGETSSMLFTCRSERPGQVTVNAITGAMDFACLPAAKAGWALEQIGSVLPQYVAVENVLHTSLTNVHAVMHPLPTLLNAARCESGTPFQYYLEGITPSVGSLAEKVDAERIAIAKAFDLNVPSVCEWMKESYGQSPATIYEAVQGNPALRGIAGPINLNTVHFFEDVSTGLVPLSELGRAVNVPTPLIDAVLDLISSLIDTDFRKEGRTLEKLGLSGLTAAGIRSAVE

SEQ ID NO: 89 - DNA, 1077 bp, Artificial Sequence
  Engineered variant of opine dehydrogenase CENDH
atgatcgagtcaaaaacatacgccgttttgggattaggaaacgggggtcacgcatttgccgcctatttagcattgaagggccagagtgtactggcttgggacatcgatgctcagagaatcaaagagattcaggaccgtggagccatcatagcggaaggaccaggacttgctgggactgctcacccggatcttctgacctcagatataggtttggcggttaaagacgctgatgtgatactgattgtagtgccggccatccaccacgcttccattgcagcaaatatcgccagttacatttccgagggtcagttgattatccttaaccctggggcaacgggtggagcgctggaattccggaaaatcctgcgtgaaaatggtgcgccggaggtaacgatcggggaaacctcaagtatgctctttacatgccgctccgagagaccaggacaggttacggtaaatgcgataacaggcgccatggactttgcatgtctcccagcggcaaaagctggatgggccctggaacagatagggtcggttcttcctcaatacgtggctgtcgaaaacgtgttgcatacttcgctgactaatccccatgctgtaatgcacccgctgccaacactgttaaacgctgctcgttgtgagtctggtaccccattccaatattatctggaggggattacgccatcagtcgggagtcttgcggagaaagtggacgctgaacgcatagcaatcgcaaaggctttcgatttaaacgttccgtcggtctgcgaatggcataaggaaagttacggccagtcaccggccacaatttatgaagcggtgcagggtaatcctgctctgcgcggcattgcgggacctattaaccttaacacgcctcacttcttcgaggatgtaagcaccggactggtaccgttatccgaactgggtcgggcagtgaatgtgcctaccccacttatcgatgctgttcttgacttgatcagttcgctgatagacacggatttcagaaaggaaggtcgtaccttggaaaaattaggtctgagcggacttaccgccgcgggcataagaagtgctgttgag

SEQ ID NO: 90 - protein, 359 aa, Artificial Sequence
  Engineered variant of opine dehydrogenase CENDH
MIESKTYAVLGLGNGGHAFAAYLALKGQSVLAWDIDAQRIKEIQDRGAIIAEGPGLAGTAHPDLLTSDIGLAVKDADVILIVVPAIHHASIAANIASYISEGQLIILNPGATGGALEFRKILRENGAPEVTIGETSSMLFTCRSERPGQVTVNAITGAMDFACLPAAKAGWALEQIGSVLPQYVAVENVLHTSLTNPHAVMHPLPTLLNAARCESGTPFQYYLEGITPSVGSLAEKVDAERIAIAKAFDLNVPSVCEWHKESYGQSPATIYEAVQGNPALRGIAGPINLNTPHFFEDVSTGLVPLSELGRAVNVPTPLIDAVLDLISSLIDTDFRKEGRTLEKLGLSGLTAAGIRSAVE

SEQ ID NO: 91 - DNA, 1077 bp, Artificial Sequence
  Engineered variant of opine dehydrogenase CENDH
atgatcgagtcaaaaacatacgccgttttgggattaggaaacgggggtcacgcatttgccgcctatttagcattgaagggccagagtgtactggcttgggacatcgatgctcagagaatcaaagagattcaggaccgtggagccatcatagcggaaggaccaggacttgctgggactgctcacccggatcttctgacctcagatataggtttggcggttaaagacgctgatgtgatactgattgtagtgccggccatccaccacgcttccattgcagcaaatatcgccagttacatttccgagggtcagttgattatccttaaccctgggatgacgggtggagcgctggaattccggaaaatcctgcgtgaaaatggtgcgccggaggtaacgatcggggaaaccggcagtatgctctttacatgccgctccgagagaccaggacaggttacggtaaatgcgatatcaggcgccatggactttgcatgtctcccagcggcaaaagctggatgggccctggaacagatagggtcggttcttcctcaatacgtggctgtcgaaaacgtgttgcatacttcgctgactaatatccatgctgtattgcacccgctgccaacactgttaaacgctgctcgttgtgagtctggtaccccattccaatattatctggaggggattacgccatcagtcgggagtcttgcggagaaagtggacgctgaacgcatagcaatcgcaaaggctttcgatttaaacgttccgtcggtctgcgaatggcataaggaaagttacggccagtcaccggccacaatttatgaagcggtgcagggtaatcctgctctgcgcggcattgcgggacctattaaccttaacacggtgcacttcttcgaggatgtaagcaccggactggtaccgttatccgaactgggtcgggcagtgaatgtgcctaccccacttatcgatgctgttcttgacttgatcagttcgctgatagacacggatttcagaaaggaaggtcgtaccttggaaaaattaggtctgagcggacttaccgccgcgggcataagaagtgctgttgag

SEQ ID NO: 92 - protein, 359 aa, Artificial Sequence
  Engineered variant of opine dehydrogenase CENDH
MIESKTYAVLGLGNGGHAFAAYLALKGQSVLAWDIDAQRIKEIQDRGAIIAEGPGLAGTAHPDLLTSDIGLAVKDADVILIVVPAIHHASIAANIASYISEGQLIILNPGMTGGALEFRKILRENGAPEVTIGETGSMLFTCRSERPGQVTVNAISGAMDFACLPAAKAGWALEQIGSVLPQYVAVENVLHTSLTNIHAVLHPLPTLLNAARCESGTPFQYYLEGITPSVGSLAEKVDAERIAIAKAFDLNVPSVCEWHKESYGQSPATIYEAVQGNPALRGIAGPINLNTVHFFEDVSTGLVPLSELGRAVNVPTPLIDAVLDLISSLIDTDFRKEGRTLEKLGLSGLTAAGIRSAVE

SEQ ID NO: 93 - DNA, 1077 bp, Artificial Sequence
  Engineered variant of opine dehydrogenase CENDH
atgatcgagtcaaaaacatacgccgttttgggattaggaaacgggggtcacgcatttgccgcctatttagcattgaagggccagagtgtactggcttgggacatcgatgctcagagaatcaaagagattcaggaccgtggagccatcatagcggaaggaccaggacttgctgggactgctcacccggatcttctgacctcagatataggtttggcggttaaagacgctgatgtgatactgattgtagtgccggccatccaccacgcttccattgcagcaaatatcgccagttacatttccgagggtcagttgattatccttaaccctggggcaacgggtggagcgctggaattccggaaaatcctgcgtgaaaatggtgcgccggaggtaacgatcggggaaacctcaagtatgctctttacatgccgctccgagagaccaggacaggttacggtaaatgcgataaaaggcgccatggactttgcatgtctcccagcggcaaaagctggatgggccctggaacagatagggtcggttcttcctcaatacgtggctgtcgaaaacgtgttgcatacttcgctgactaatatcgaagctgtaatgcacccgctgccaacactgttaaacgctgctcgttgtgagtctggtaccccattccaatattatctggaggggattacgccatcagtcgggagtcttgcggagaaagtggacgctgaacgcatagcaatcgcaaaggctttcgatttaaacgttccgtcggtctgcgaatggatgaaggaaagttacggccagtcaccggccacaatttatgaagcggtgcagggtaatcctgctctgcgcggcattgcgggacctattaaccttaacacgcgctacttcttcgaggatgtaagcaccggactggtaccgttatccgaactgggtcgggcagtgaatgtgcctaccccacttatcgatgctgttcttgacttgatcagttcgctgatagacacggatttcagaaaggaaggtcgtaccttggaaaaattaggtctgagcggacttaccgccgcgggcataagaagtgctgttgag

SEQ ID NO: 94 - protein, 359 aa, Artificial Sequence
  Engineered variant of opine dehydrogenase CENDH
MIESKTYAVLGLGNGGHAFAAYLALKGQSVLAWDIDAQRIKEIQDRGAIIAEGPGLAGTAHPDLLTSDIGLAVKDADVILIVVPAIHHASIAANIASYISEGQLIILNPGATGGALEFRKILRENGAPEVTIGETSSMLFTCRSERPGQVTVNAIKGAMDFACLPAAKAGWALEQIGSVLPQYVAVENVLHTSLTNIEAVMHPLPTLLNAARCESGTPFQYYLEGITPSVGSLAEKVDAERIAIAKAFDLNVPSVCEWMKESYGQSPATIYEAVQGNPALRGIAGPINLNTRYFFEDVSTGLVPLSELGRAVNVPTPLIDAVLDLISSLIDTDFRKEGRTLEKLGLSGLTAAGIRSAVE

SEQ ID NO: 95 - DNA, 1077 bp, Artificial Sequence
  Engineered variant of opine dehydrogenase CENDH
atgatcgagtcaaaaacatacgccgttttgggattaggaaacgggggtcacgcatttgccgcctatttagcattgaagggccagagtgtactggcttgggacatcgatgctcagagaatcaaagagattcaggaccgtggagccatcatagcggaaggaccaggacttgctgggactgctcacccggatcttctgacctcagatataggtttggcggttaaagacgctgatgtgatactgattgtagtgccggccatccaccacgcttccattgcagcaaatatcgccagttacatttccgagggtcagttgattatccttaaccctggggcaacgggtggagcgctggaattccggaaaatcctgcgtgaaaatggtgcgccggaggtaacgatcggggaaacctcaagtatgctctttacatgccgctccgagagaccaggacaggttacggtaaatgcgataacaggcgccatggactttgcatgtctcccagcggcaaaagctggatgggccctggaacagatagggtcggttcttcctcaatacgtggctgtcgaaaacgtgttgcatacttcgctgactaatatcgaagctgtattgcacccgctgccaacactgttaaacgctgctcgttgtgagtctggtaccccattccaatattatctggaggggattacgccatcagtcgggagtcttgcggagaaagtggacgctgaacgcatagcaatcgcaaaggctttcgatttaaacgttccgtcggtctgcgaatggcataaggaaagttacggccagtcaccggccacaatttatgaagcggtgcagggtaatcctgctctgcgcggcattgcgggacctattaaccttaacacggtgcacttcttcgaggatgtaagcaccggactggtaccgttatccgaactgggtcgggcagtgaatgtgcctaccccacttatcgatgctgttcttgacttgatcagttcgctgatagacacggatttcagaaaggaaggtcgtaccttggaaaaattaggtctgagcggacttaccgccgcgggcataagaagtgctgttgag

SEQ ID NO: 96 - protein, 359 aa, Artificial Sequence
  Engineered variant of opine dehydrogenase CENDH
MIESKTYAVLGLGNGGHAFAAYLALKGQSVLAWDIDAQRIKEIQDRGAIIAEGPGLAGTAHPDLLTSDIGLAVKDADVILIVVPAIHHASIAANIASYISEGQLIILNPGATGGALEFRKILRENGAPEVTIGETSSMLFTCRSERPGQVTVNAITGAMDFACLPAAKAGWALEQIGSVLPQYVAVENVLHTSLTNIEAVLHPLPTLLNAARCESGTPFQYYLEGITPSVGSLAEKVDAERIAIAKAFDLNVPSVCEWHKESYGQSPATIYEAVQGNPALRGIAGPINLNTVHFFEDVSTGLVPLSELGRAVNVPTPLIDAVLDLISSLIDTDFRKEGRTLEKLGLSGLTAAGIRSAVE

SEQ ID NO: 97 - DNA, 1077 bp, Artificial Sequence
  Engineered variant of opine dehydrogenase CENDH
atgatcgagtcaaaaacatacgccgttttgggattaggaaacgggggtcacgcatttgccgcctatttagcattgaagggccagagtgtactggcttgggacatcgatgctcagagaatcaaagagattcaggaccgtggagccatcatagcggaaggaccaggacttgctgggactgctcacccggatcttctgacctcagatataggtttggcggttaaagacgctgatgtgatactgattgtagtgccggccatccaccacgcttccattgcagcaaatatcgccagttacatttccgagggtcagttgattatccttaaccctgggatgacgggtggagcgctggaattccggaaaatcctgcgtgaaaatggtgcgccggaggtaacgatcggggaaaccggcagtatgctctttacatgccgctccgagagaccaggacaggttacggtaaatgcgataaaaggcgccatggactttgcatgtctcccagcggcaaaagctggatgggccctggaacagatagggtcggttcttcctcaatacgtggctgtcgaaaacgtgttgcatacttcgctgactaatgtccatgctgtaatgcacccgctgccaacactgttaaacgctgctcgttgtgagtctggtaccccattccaatattatctggaggggattacgccatcagtcgggagtcttgcggagaaagtggacgctgaacgcatagcaatcgcaaaggctttcgatttaaacgttccgtcggtctgcgaatggatgaaggaaagttacggccagtcaccggccacaatttatgaagcggtgcagggtaatcctgctctgcgcggcattgcgggacctattaaccttaacacgagtcacttcttcgaggatgtaagcaccggactggtaccgttatccgaactgggtcgggcagtgaatgtgcctaccccacttatcgatgctgttcttgacttgatcagttcgctgatagacacggatttcagaaaggaaggtcgtaccttggaaaaattaggtctgagcggacttaccgccgcgggcataagaagtgctgttgag

SEQ ID NO: 98 - protein, 359 aa, Artificial Sequence
  Engineered variant of opine dehydrogenase CENDH
MIESKTYAVLGLGNGGHAFAAYLALKGQSVLAWDIDAQRIKEIQDRGAIIAEGPGLAGTAHPDLLTSDIGLAVKDADVILIVVPAIHHASIAANIASYISEGQLIILNPGMTGGALEFRKILRENGAPEVTIGETGSMLFTCRSERPGQVTVNAIKGAMDFACLPAAKAGWALEQIGSVLPQYVAVENVLHTSLTNVHAVMHPLPTLLNAARCESGTPFQYYLEGITPSVGSLAEKVDAERIAIAKAFDLNVPSVCEWMKESYGQSPATIYEAVQGNPALRGIAGPINLNTSHFFEDVSTGLVPLSELGRAVNVPTPLIDAVLDLISSLIDTDFRKEGRTLEKLGLSGLTAAGIRSAVE

SEQ ID NO: 99 - DNA, 1077 bp, Artificial Sequence
  Engineered variant of opine dehydrogenase CENDH
atgatcgagtcaaaaacatacgccgttttgggattaggaaacgggggtcacgcatttgccgcctatttagcattgaagggccagagtgtactggcttgggacatcgatgctcagagaatcaaagagattcaggaccgtggagccatcatagcggaaggaccaggacttgctgggactgctcacccggatcttctgacctcagatataggtttggcggttaaagacgctgatgtgatactgattgtagtgccggccatccaccacgcttccattgcagcaaatatcgccagttacatttccgagggtcagttgattatccttaaccctggggcaacgggtggagcgctggaattccggaaaatcctgcgtgaaaatggtgcgccggaggtaacgatcggggaaacctcaagtatgctctttacatgccgctccgagagaccaggacaggttacggtaaatgcgatagtaggcgccatggactttgcatgtctcccagcggcaaaagctggatgggccctggaacagatagggtcggttcttcctcaatacgtggctgtcgaaaacgtgttgcatacttcgctgactaatcctgaagctgtattgcacccgctgccaacactgttaaacgctgctcgttgtgagtctggtaccccattccaatattatctggaggggattacgccatcagtcgggagtcttgcggagaaagtggacgctgaacgcatagcaatcgcaaaggctttcgatttaaacgttccgtcggtctgcgaatggatgaaggaaagttacggccagtcaccggccacaatttatgaagcggtgcagggtaatcctgctctgcgcggcattgcgggacctattaaccttaacacgacttacttcttcgaggatgtaagcaccggactggtaccgttatccgaactgggtcgggcagtgaatgtgcctaccccacttatcgatgctgttcttgacttgatcagttcgctgatagacacggatttcagaaaggaaggtcgtaccttggaaaaattaggtctgagcggacttaccgccgcgggcataagaagtgctgttgag

SEQ ID NO: 100 - protein, 359 aa, Artificial Sequence
  Engineered variant of opine dehydrogenase CENDH
MIESKTYAVLGLGNGGHAFAAYLALKGQSVLAWDIDAQRIKEIQDRGAIIAEGPGLAGTAHPDLLTSDIGLAVKDADVILIVVPAIHHASIAANIASYISEGQLIILNPGATGGALEFRKILRENGAPEVTIGETSSMLFTCRSERPGQVTVNAIVGAMDFACLPAAKAGWALEQIGSVLPQYVAVENVLHTSLTNPEAVLHPLPTLLNAARCESGTPFQYYLEGITPSVGSLAEKVDAERIAIAKAFDLNVPSVCEWMKESYGQSPATIYEAVQGNPALRGIAGPINLNTTYFFEDVSTGLVPLSELGRAVNVPTPLIDAVLDLISSLIDTDFRKEGRTLEKLGLSGLTAAGIRSAVE

SEQ ID NO: 101 - DNA, 1197 bp, Artificial Sequence
  Codon optimized D-octopine dehydrogenase from Pecten maximus (great scallop) [OpDH]
atgacagtgaaagtatgcgtttgcggaggtgggaatggcgcccatactttatcagggcttgccgccagccgcgatggggttgaagtgcgtgtcttgacactttttgccgatgaagccgaacgctggactaaagcactgggagcagatgagttgaccgtgatcgtgaatgagaaagacggcacccagactgaagtgaaatcgcgccccaaggtcatcactaaagatcctgaaatcgctatttcgggggcagacgtggtgattcttacggttccagcctttgcacacgagggctattttcaggcgatggcaccatatgttcaagactcggcgttaattgtgggtttaccatcccaggccggatttgaatttcaatgtcgggacattttgggtgataaggcggccgccgtttccatgatgagcttcgaaactttgccttgggcctgcagaatcaaagaatttgggcgcaaagttgaggtcttaggtacgaaaagcgtactggctgctagtcttatcaaagggactgcgaaaactgtcgatcctctgtctacgttacagatgcttcatggggctgaaccagtgttccgcttagcgaagcatttcctggagatgctgattatgagttactcattcgtccacccggccatattatttggtcgctggggtagttgggatggtaagcctgtgccggaagctccgctgttttaccaggggatagaccaggccacagcggatatgctgacagcatgctcgaatgaatgcaaagatgtggcgaatgctattatggccgcgtgtccaggcaacgatctctccgacgttaaggacatctaccagtggtaccttgagtactaccatgaagatatacaggacgaccatgatctgtaccatgccatcacaacgaacaaatcgtacaagggattggtccacccggtcaaggcggtagatggtggtgtggccccggatttcggaaaccgctacctgacagaggacattccgatgggcatgattgtatttaaaggcgtcgccatcgcagcaggcgtggcaatacccagcaacgataaactcatcatgtgggctcaagagaaaatcggcaaggagtacctcgtggacggtgcactcacggggaaagatgtcgcgacgacgcgttgtccgcagcgctatggctttaatacgctggatgctattctgactggcaagaaa

SEQ ID NO: 102 - protein, 399 aa, Pecten maximus
MTVKVCVCGGGNGAHTLSGLAASRDGVEVRVLTLFADEAERWTKALGADELTVIVNEKDGTQTEVKSRPKVITKDPEIAISGADVVILTVPAFAHEGYFQAMAPYVQDSALIVGLPSQAGFEFQCRDILGDKAAAVSMMSFETLPWACRIKEFGRKVEVLGTKSVLAASLIKGTAKTVDPLSTLQMLHGAEPVFRLAKHFLEMLIMSYSFVHPAILFGRWGSWDGKPVPEAPLFYQGIDQATADMLTACSNECKDVANAIMAACPGNDLSDVKDIYQWYLEYYHEDIQDDHDLYHAITTNKSYKGLVHPVKAVDGGVAPDFGNRYLTEDIPMGMIVFKGVAIAAGVAIPSNDKLIMWAQEKIGKEYLVDGALTGKDVATTRCPQRYGFNTLDAILTGKK

SEQ ID NO: 103 - DNA, 939 bp, Artificial Sequence
  Codon optimized Ornithine synthase from Lactococcus lactis K1 [CEOS]
atgaaaattggactggtcaaagcaaacttccccggagaacggcgcgttcctttgcttccgaaagatatcaaggatttcaaaaacgagatattagtagaagagggcttcggtaaatttctggatattgacgatcaggagtattcagacaagggttgtcatatcttaagtcgggccgaagttttcgcggaatcagaagctatcttctcgctgaaattgattcaaccaacagattactatcatcttcgtgaaggacagatgattattgggtggactcatccattcgggagtggccagtcgtttatgaaagaacaggcgctgcctaagaagttgatcgttgtggatcttgattccaattcgccgtgcatatattatgaaaacgagatttttgaaagtggcatccctaaagggttgctctataaaaattctttttatgcgggttacgccggtgttctggatgctttgttacagtatgggctcatacctactgaggagacaaaaatcgcaattttagggtctgggaacgttgcacagggtgcattctcgtctatctctaaatattcgagtaacattcggatgtattatagaaagaccatgtcaatctttaaggagaattatacgaagtacgatataatcatcaacggtatcgaaattggaaaagacgacgatcccatcttgtcattctctgaacaaaagtccctcaaaaagggaacactgattatagatgtagccgccgacgctggcaatacgatcgaggggagtcactttacatctatagatgcaccaatatatgaaaacgccgggaagtattactatgtcgtaccgaatacgcctagtctgatctacagaaatgttagtcaagaactgtcaaaaattctgagtgaaaacatttttcgcaaggactgttcacggtttatcgaaaaagtaaaacctctgaacaaa

SEQ ID NO: 104 - protein, 313 aa, Lactococcus lactis K1
MKIGLVKANFPGERRVPLLPKDIKDFKNEILVEEGFGKFLDIDDQEYSDKGCHILSRAEVFAESEAIFSLKLIQPTDYYHLREGQMIIGWTHPFGSGQSFMKEQALPKKLIVVDLDSNSPCIYYENEIFESGIPKGLLYKNSFYAGYAGVLDALLQYGLIPTEETKIAILGSGNVAQGAFSSISKYSSNIRMYYRKTMSIFKENYTKYDIIINGIEIGKDDDPILSFSEQKSLKKGTLIIDVAADAGNTIEGSHFTSIDAPIYENAGKYYYVVPNTPSLIYRNVSQELSKILSENIFRKDCSRFIEKVKPLNK

SEQ ID NO: 105 - DNA, 1023 bp, Artificial Sequence
  Codon optimized N-methyl-L-amino acid dehydrogenase from Pseudomonas putida [NMDH]
atgagcgcaccatccacgagcaccgtagtgcgcgtcccctttacagaactgcaatctttactgcaagccatcttccagcgtcacgggtgtagcgaagctgtagctcgtgtgcttgcacataactgcgcaagtgcacagcgcgatggcgcgcatagtcacggcgtgtttcgtatgccgggctatgtctcgactttagcaagcggttgggttgatggtcaggccactccacaggtgagtgatgttgcagcgggctatgttcgtgttgacgcagcaggtggctttgcacagccagcacttgcagcagcacgtgaactgctggtcgcgaaggcacgtagtgcaggtattgcagttctggccatccacaacagccaccatttcgcagcactgtggccagatgttgaaccgtttgcagaagaaggtctggttgcactgagcgttgtcaacagcatgacttgcgttgttccacatggtgcacgtaaaccgctgttcggcaccaatcccattgcatttgcagcaccgtgcgcagagcatgatccgatcgtgtttgacatggccacgagcgcaatggcacatggtgatgtgcagattgcagcacgtgcaggtcagcagctgccggaaggtatgggtgttgatgcagatggtcagccaactactgatccgaaggcgattctggaaggtggtgcgttgttaccatttggcggtcataagggttcggcgttgagcatgatggtcgagctgttagcagcggcactgactggtggtcactttagttgggagttcgattggagcggtcatccaggtgcgaagaccccgtggacgggtcagttgatcatcgtgatcaatccaggtaaagcagaaggtgaacgcttcgcccagcgcagtcgtgagttagtggaacacatgcaggccgttggtctgacccgcatgccgggtgaacgtcgctaccgtgagcgcgaggtggcggaagaagaaggtgttgcggtgaccgaacaggagttgcaaggcctgaaagaactgcttggt

SEQ ID NO: 106 - protein, 341 aa, Pseudomonas putida
MSAPSTSTVVRVPFTELQSLLQAIFQRHGCSEAVARVLAHNCASAQRDGAHSHGVFRMPGYVSTLASGWVDGQATPQVSDVAAGYVRVDAAGGFAQPALAAARELLVAKARSAGIAVLAIHNSHHFAALWPDVEPFAEEGLVALSVVNSMTCVVPHGARKPLFGTNPIAFAAPCAEHDPIVFDMATSAMAHGDVQIAARAGQQLPEGMGVDADGQPTTDPKAILEGGALLPFGGHKGSALSMMVELLAAALTGGHFSWEFDWSGHPGAKTPWTGQLIIVINPGKAEGERFAQRSRELVEHMQAVGLTRMPGERRYREREVAEEEGVAVTEQELQGLKELLG

SEQ ID NO: 107 - DNA, 1206 bp, Artificial Sequence
  Codon optimized Beta-alanopine dehydrogenase from Cellana grata [BADH]
atgcaggaaaagctgattgttgttgtttgtggaggtggtaacgccgcccacgtcatgtcgggtctttctgcatcacgtgaaaatgtggaagtccgtgtcttggacgtttttagcgacgaggccgaacgttggacgaaaactcttggtgatgattctattgtcctgacagtaaatcaccccgatggcagtcacgatgaagtccgcggtaaaccaaatttcattacgaacgacgcgtcaaaagctgtccccggcgctaacctcatcgtgtttgctgttccagctttcgcgcatgagtcatattttgaagccatcaagccttatgttaaacccaatatgattatagtgggcatgcctgggcagccaggctttgagtttcaatgtttttccattctgaaagacattgcccctaagtgctgtgtgattgttttcgaggggcttccttgggcggcacgcattaccgagttcggaagagcgatcaccgtattgtctacgaaagacttcttaaattgcgttgtgatcaaaggggaatcgaaaattgagggagatccccttaaaccgattcaatacctgttgggtccacatcctgtcgcgacgaaactgcataatttccttgaaccgacgctcagcactaagtcgatcatgcaccctccaattatgtatggggcttggaaggattgggatggtaaccctttgtcagagaagccgctgttctatcagggactgaccgaagaagccgccgagcttatgagcggtatgtccgatgaacttcttgcgacagctaaagcgattagcctgaaaaagcctgaaatcaatctggatggagtttcacacatacgtgattggatgtaccaagcctatggtcgtgagtgttcggacacttctaacttgctccaaatgttacgtacgaactcagcttacaatggcctgttgcatcctatgaaagaggttaaaccgggtaaatttatgccggacttcacgtttcggtacctgacagaggatatcccgtttggcgttgtcgtattgaagggaatttccgaactggctggcgttgatactcctatcacagacaaagtgcttgcatggggacagcagataattggcaaagagtatctggtgggcaaaagcctttgcggaaaagacgtcgctacctctagagctccacagcggtatgggtataagtccctggacgactttgacccattgttg

SEQ ID NO: 108 - protein, 402 aa, Cellana grata
MQEKLIVVVCGGGNAAHVMSGLSASRENVEVRVLDVFSDEAERWTKTLGDDSIVLTVNHPDGSHDEVRGKPNFITNDASKAVPGANLIVFAVPAFAHESYFEAIKPYVKPNMIIVGMPGQPGFEFQCFSILKDIAPKCCVIVFEGLPWAARITEFGRAITVLSTKDFLNCVVIKGESKIEGDPLKPIQYLLGPHPVATKLHNFLEPTLSTKSIMHPPIMYGAWKDWDGNPLSEKPLFYQGLTEEAAELMSGMSDELLATAKAISLKKPEINLDGVSHIRDWMYQAYGRECSDTSNLLQMLRTNSAYNGLLHPMKEVKPGKFMPDFTFRYLTEDIPFGVVVLKGISELAGVDTPITDKVLAWGQQIIGKEYLVGKSLCGKDVATSRAPQRYGYKSLDDFDPLL

SEQ ID NO: 109 - DNA, 1011 bp, Artificial Sequence
  Codon optimized Tauropine dehydrogenase from Suberites domuncula [TauDH]
atgtctaagaaactgacctttctgtacttatcggagccagacgtaattaaaacgggcctgacgttgacggagacgattgagctctgcactgaaagcttgaaacagcatggccttaaagaagtagaaaaccctcctaaaccgggtgtacaccctaaagaagacagtttcattaacgcgatgccgggctggttgaaacagaaaggagtttgtggcattaagtgggtatccggctttcctgagaatgtaaagcagcgcctgccatctatcgttggagtaataatcttgaactcaactgaaacgggattccctacggctgttatggatggcacgtacattacagctattcgcaccgctgcagtcagtggtgtgtccgcaaagtaccttgctcgtaaagattctgaagtgttagccgtaattggtaccggtgtacagggtaagtataatacgttatgcctgacgacagtgttaccctcaattaagaaagtaaaaatctttgacacctgggcaccctcgctgcaaacttttcaagatcagatcagaccactgctgcctaacgtcgaatttgaaacggcgtcgtccatggaggaggctatccgtgattcagacgtcattgtaggagccactgctaagttaacagaaacggtatactccgatgagtgggttaaaccgggtgctcttgttcttcctatccaggtgggaggttgggatccggatgtgctgagcaagtttgataaagtcgtagcagacgattgggcgcagttaaaggcacagcaagacttctcacggtatacgtcgaattttgatacgccgtatgcagaactcggagaaatcgttatgggtaagaagccaggacgcgagaatgaccaggagaagatcattaattttaacaaaggtctggcggtgcatgacatgatctgcggtggccgggttcttgaaaaagcgaagaaacaaggtctgggtgttgaactggagttaatggatcttggctcccctattcctatgccgcctgtt

SEQ ID NO: 110 - protein, 337 aa, Suberites domuncula
MSKKLTFLYLSEPDVIKTGLTLTETIELCTESLKQHGLKEVENPPKPGVHPKEDSFINAMPGWLKQKGVCGIKWVSGFPENVKQRLPSIVGVIILNSTETGFPTAVMDGTYITAIRTAAVSGVSAKYLARKDSEVLAVIGTGVQGKYNTLCLTTVLPSIKKVKIFDTWAPSLQTFQDQIRPLLPNVEFETASSMEEAIRDSDVIVGATAKLTETVYSDEWVKPGALVLPIQVGGWDPDVLSKFDKVVADDWAQLKAQQDFSRYTSNFDTPYAELGEIVMGKKPGRENDQEKIINFNKGLAVHDMICGGRVLEKAKKQGLGVELELMDLGSPIPMPPV

SEQ ID NO: 111 - DNA, 1077 bp, Artificial Sequence
  Engineered variant of opine dehydrogenase CENDH
atgatcgagtcaaaaacatacgccgttttgggattaggaaacgggggtcacgcatttgccgcctatttagcattgaagggccagagtgtactggcttgggacatcgatgctcagagaatcaaagagattcaggaccgtggagccatcatagcggaaggaccaggacttgctgggactgctcacccggatcttctgacctcagatataggtttggcggttaaagacgctgatgtgatactgattgtagtgccggccatccaccacgcttccattgcagcaaatatcgccagttacatttccgagggtcagttgattatccttaaccctggggcaacgggtggagcgctggaattccggaaaatcctgcgtgaaaatggtgcgccggaggtaacgatcggggaaacctcaagtatgctctttacatgccgctccgagagaccaggacaggttacggtaaatgcgataacaggcgccatggactttgcatgtctcccagcggcaaaagctggatgggccctggaacagatagggtcggttcttcctcaatacgtggctgtcgaaaacgtgttgcatacttcgctgactaatatcgaagctgtattgcacccgctgccaacactgttaaacgctgctcgttgtgagtctggtaccccattccaatattatctggaggggattacgccatcagtcgggagtcttgcggagaaagtggacgctgaacgcatagcaatcgcaaaggctttcgatttaaacgttccgtcggtctgcgaatggcataaggaaagttacggccagtcaccggccacaatttatgaagcggtgcagggtaatcctgctctgcgcggcattatgggacctattaaccttaacacggtgcacttcttcgaggatgtaagcaccggactggtaccgttatccgaactgggtcgggcagtgaatgtgcctaccccacttatcgatgctgttcttgacttgatcagttcgctgatagacacggatttcagaaaggaaggtcgtaccttggaaaaattaggtctgagcggacttaccgccgcgggcataagaagtgctgttgag

SEQ ID NO: 112 - protein, 359 aa, Artificial Sequence
  Engineered variant of opine dehydrogenase CENDH
MIESKTYAVLGLGNGGHAFAAYLALKGQSVLAWDIDAQRIKEIQDRGAIIAEGPGLAGTAHPDLLTSDIGLAVKDADVILIVVPAIHHASIAANIASYISEGQLIILNPGATGGALEFRKILRENGAPEVTIGETSSMLFTCRSERPGQVTVNAITGAMDFACLPAAKAGWALEQIGSVLPQYVAVENVLHTSLTNIEAVLHPLPTLLNAARCESGTPFQYYLEGITPSVGSLAEKVDAERIAIAKAFDLNVPSVCEWHKESYGQSPATIYEAVQGNPALRGIMGPINLNTVHFFEDVSTGLVPLSELGRAVNVPTPLIDAVLDLISSLIDTDFRKEGRTLEKLGLSGLTAAGIRSAVE

SEQ ID NO: 113 - DNA, 1077 bp, Artificial Sequence
  Engineered variant of opine dehydrogenase CENDH
atgatcgagtcaaaaacatacgccgttttgggattaggaaacgggggtcacgcatttgccgcctatttagcattgaagggccagagtgtactggcttgggacatcgatgctcagagaatcaaagagattcaggaccgtggagccatcatagcggaaggaccaggacttgctgggactgctcacccggatcttctgacctcagatataggtttggcggttaaagacgctgatgtgatactgattgtagtgccggccatccaccacgcttccattgcagcaaatatcgccagttacatttccgagggtcagttgattatccttaaccctggggcaacgggtggagcgctggaattccggaaaatcctgcgtgaaaatggtgcgccggaggtaacgatcggggaaacctcaagtatgctctttacatgccgctccgagagaccaggacaggttacggtaaatgcgataacaggcgccatggactttgcatgtctcccagcggcaaaagctggatgggccctggaacagatagggtcggttcttcctcaatacgtggctgtcgaaaacgtgttgcatacttcgctgactaatatcgaagctgtattgcacccgctgccaacactgttaaacgctgctcgttgtgagtctggtaccccattccaatattatctggaggggattacgccatcagtcgggagtcttgcggagaaagtggacgctgaacgcatagcaatcgcaaaggctttcgatttaaacgttccgtcggtctgcgaatggcataaggaaagttacggccagtcaccggccacaatttatgaagcggtgcagggtaatcctgctctgcgcggcattgcgggacctattaaccttaacacggtgcacttcttcgaggatgtaagcaccggactggtaccgttatccgaactgggtcgggcagtgaatgtgcctaccccacttatcgatgctgttcttactttgatcagttcgctgatagacacggatttcagaaaggaaggtcgtaccttggaaaaattaggtctgagcggacttaccgccgcgggcataagaagtgctgttgag

SEQ ID NO: 114 - protein, 359 aa, Artificial Sequence
  Engineered variant of opine dehydrogenase CENDH
MIESKTYAVLGLGNGGHAFAAYLALKGQSVLAWDIDAQRIKEIQDRGAIIAEGPGLAGTAHPDLLTSDIGLAVKDADVILIVVPAIHHASIAANIASYISEGQLIILNPGATGGALEFRKILRENGAPEVTIGETSSMLFTCRSERPGQVTVNAITGAMDFACLPAAKAGWALEQIGSVLPQYVAVENVLHTSLTNIEAVLHPLPTLLNAARCESGTPFQYYLEGITPSVGSLAEKVDAERIAIAKAFDLNVPSVCEWHKESYGQSPATIYEAVQGNPALRGIAGPINLNTVHFFEDVSTGLVPLSELGRAVNVPTPLIDAVLTLISSLIDTDFRKEGRTLEKLGLSGLTAAGIRSAVE

SEQ ID NO: 115 - DNA, 1077 bp, Artificial Sequence
  Engineered variant of opine dehydrogenase CENDH
atgatcgagtcaaaaacatacgccgttttgggattaggaaacgggggtcacgcatttgccgcctatttagcattgaagggccagagtgtactggcttgggacatcgatgctcagagaatcaaagagattcaggaccgtggagccatcatagcggaaggaccaggacttgctgggactgctcacccggatcttctgacctcagatataggtttggcggttaaagacgctgatgtgatactgattgtagtgccggccatccaccacgcttccattgcagcaaatatcgccagttacatttccgagggtcagttgattatccttaaccctggggcaacgggtggagcgctggaattccggaaaatcctgcgtgaaaatggtgcgccggaggtaacgatcggggaaacctcaagtatgctctttacatgccgctccgagagaccaggacaggttacggtaaatgcgataacaggcgccatgaactttgcatgtctcccagcggcaaaagctggatgggccctggaacagatagggtcggttcttcctcaatacgtggctgtcgaaaacgtgttgcatacttcgctgactaatatcgaagctgtattgcacccgctgccaacactgttaaacgctgctcgttgtgagtctggtaccccattccaatattatctggaggggattacgccatcagtcgggagtcttgcggagaaagtggacgctgaacgcatagcaatcgcaaaggctttcgatttaaacgttccgtcggtctgcgaatggcataaggaaagttacggccagtcaccggccacaatttatgaagcggtgcagggtaatcctgctctgcgcggcattgcgggacctattaaccttaacacggtgcacttcttcgaggatgtaagcaccggactggtaccgttatccgaactgggtcgggcagtgaatgtgcctaccccacttatcgatgctgttcttgacttgatcagttcgctgatagacacggatttcagaaaggaaggtcgtaccttggaaaaattaggtctgagcggacttaccgccgcgggcataagatcggctgttgag

SEQ ID NO: 116 - protein, 359 aa, Artificial Sequence
  Engineered variant of opine dehydrogenase CENDH
MIESKTYAVLGLGNGGHAFAAYLALKGQSVLAWDIDAQRIKEIQDRGAIIAEGPGLAGTAHPDLLTSDIGLAVKDADVILIVVPAIHHASIAANIASYISEGQLIILNPGATGGALEFRKILRENGAPEVTIGETSSMLFTCRSERPGQVTVNAITGAMNFACLPAAKAGWALEQIGSVLPQYVAVENVLHTSLTNIEAVLHPLPTLLNAARCESGTPFQYYLEGITPSVGSLAEKVDAERIAIAKAFDLNVPSVCEWHKESYGQSPATIYEAVQGNPALRGIAGPINLNTVHFFEDVSTGLVPLSELGRAVNVPTPLIDAVLDLISSLIDTDFRKEGRTLEKLGLSGLTAAGIRSAVE

SEQ ID NO: 117 - DNA, 1077 bp, Artificial Sequence
  Engineered variant of opine dehydrogenase CENDH
atgatcgagtcaaaaacatacgccgttttgggattaggaaacgggggtcacgcatttgccgcctatttagcattgaagggccagagtgtactggcttgggacatcgatgctcagagaatcaaagagattcaggaccgtggagccatcatagcggaaggaccaggacttgctgggactgctcacccggatcttctgacctcagatataggtttggcggttaaagacgctgatgtgatactgattgtagtgccggccatccaccacgcttccattgcagcaaatatcgccagttacatttccgagggtcagttgattatccttaaccctggggcaacgggtggagcgctggaattccggaaaatcctgcgtgaaaatggtgcgccggaggtaacgatcggggaaacctcaagtatgctctttacatgccgctccgagagaccaggacaggttacggtaaatgcgataacaggcgccatggactttgcatgtctcccagcggcaaaagctggatgggccctggaacagatagggtcggttcttcctcaataccgggctgtcgaaaacgtgttgcatacttcgctgactaatatcgaagctgtattgcacccgctgccaacactgttaaacgctgctcgttgtgagtctggtaccccattccaatattatctggaggggattacgccatcagtcgggagtcttgcggagaaagtggacgctgaacgcatagcaatcgcaaaggctttcgatttaaacgttccgtcggtctgcgaatggcataaggaaagttacggccagtcaccggccacaatttatgaagcggtgcagggtaatcctgctctgcgcggcattgcaggacctattaaccttaacacggtgcacttcttcgaggatgtaagcaccggactggtaccgttatccgaactgggtcgggcagtgaatgtgcctaccccacttatcgatgctgttcttgacttgatcagttcgctgatagacacggatttcagaaaggaaggtcgtaccttggaaaaattaggtctgagcggacttaccgccgcgggcataagaagtgctgttgag

SEQ ID NO: 118 - protein, 359 aa, Artificial Sequence
  Engineered variant of opine dehydrogenase CENDH
MIESKTYAVLGLGNGGHAFAAYLALKGQSVLAWDIDAQRIKEIQDRGAIIAEGPGLAGTAHPDLLTSDIGLAVKDADVILIVVPAIHHASIAANIASYISEGQLIILNPGATGGALEFRKILRENGAPEVTIGETSSMLFTCRSERPGQVTVNAITGAMDFACLPAAKAGWALEQIGSVLPQYRAVENVLHTSLTNIEAVLHPLPTLLNAARCESGTPFQYYLEGITPSVGSLAEKVDAERIAIAKAFDLNVPSVCEWHKESYGQSPATIYEAVQGNPALRGIAGPINLNTVHFFEDVSTGLVPLSELGRAVNVPTPLIDAVLDLISSLIDTDFRKEGRTLEKLGLSGLTAAGIRSAVE

SEQ ID NO: 119 - DNA, 1077 bp, Artificial Sequence
  Engineered variant of opine dehydrogenase CENDH
atgatcgagtcaaaaacatacgccgttttgggattaggaaacgggggtcacgcatttgccgcctatttagcattgaagggccagagtgtactggcttgggacatcgatgctcagagaatcaaagagattcaggaccgtggagccatcatagcggaaggaccaggacttgctgggactgctcacccggatcttctgacctcagatataggtttggcggttaaagacgctgatgtgatactgattgtagtgccggccatccaccacgcttccattgcagcaaatatcgccagttacatttccgagggtcagttgattatccttaaccctggggcaacgggtggagcgctggaattccggaaaatcctgcgtgaaaatggtgcgccggaggtaacgatcggggaaacctcaagtatgctctttacatgccgctccgagagaccaggacaggttacggtaaatgcgataacaggcgccatggactttgcatgtctcccagcggcaaaagctggatgggccctggaacagatagggtcggttcttcctcaatacgtggctagggaaaacgtgttgcatacttcgctgactaatatcgaagctgtattgcacccgctgccaacactgttaaacgctgctcgttgtgagtctggtaccccattccaatattatctggaggggattacgccatcagtcgggagtcttgcggagaaagtggacgctgaacgcatagcaatcgcaaaggctttcgatttaaacgttccgtcggtctgcgaatggcataaggaaagttacggccagtcaccggccacaatttatgaagcggtgcagggtaatcctgctctgcgcggcattgcgggacctattaaccttaacacggtgcacttcttcgaggatgtaagcaccggactggtaccgttatccgaactgggtcgggcagtgaatgtgcctaccccacttatcgatgctgttcttgacttgatcagttcgctgatagacacggatttcagaaaggaaggtcgtaccttggaaaaattaggtctgagcggacttaccgccgcgggcataagaagtgctgttgag

SEQ ID NO: 120 - protein, 359 aa, Artificial Sequence
  Engineered variant of opine dehydrogenase CENDH
MIESKTYAVLGLGNGGHAFAAYLALKGQSVLAWDIDAQRIKEIQDRGAIIAEGPGLAGTAHPDLLTSDIGLAVKDADVILIVVPAIHHASIAANIASYISEGQLIILNPGATGGALEFRKILRENGAPEVTIGETSSMLFTCRSERPGQVTVNAITGAMDFACLPAAKAGWALEQIGSVLPQYVARENVLHTSLTNIEAVLHPLPTLLNAARCESGTPFQYYLEGITPSVGSLAEKVDAERIAIAKAFDLNVPSVCEWHKESYGQSPATIYEAVQGNPALRGIAGPINLNTVHFFEDVSTGLVPLSELGRAVNVPTPLIDAVLDLISSLIDTDFRKEGRTLEKLGLSGLTAAGIRSAVE

SEQ ID NO: 121 - DNA, 1077 bp, Artificial Sequence
  Engineered variant of opine dehydrogenase CENDH
atgatcgagtcaaaaacatacgccgttttgggattaggaaacgggggtcacgcatttgccgcctatttagcattgaagggccagagtgtactggcttgggacatcgatgctcagagaatcaaagagattcaggaccgtggagccatcatagcggaaggaccaggacttgctgggactgctcacccggatcttctgacctcagatataggtttggcggttaaagacgctgatgtgatactgattgtagtgccggccatccaccacgcttccattgcagcaaatatcgccagttacatttccgagggtcagttgattatccttaaccctggggcaacgggtggagcgctggaattccggaaaatcctgcgtgaaaatggtgcgccggaggtaacgatcggggaaacctcaagtatgctctttacatgccgctccgagagaccaggacaggttacggtaaatgcgataacattggccatggactttgcatgtctcccagcggcaaaagctggatgggccctggaacagatagggtcggttcttcctcaatacgtggctgtcgaaaacgtgttgcatacttcgctgactaatatcgaagctgtattgcacccgctgccaacactgttaaacgctgctcgttgtgagtctggtaccccattccaatattatctggaggggattacgccatcagtcgggagtcttgcggagaaagtggacgctgaacgcatagcaatcgcaaaggctttcgatttaaacgttccgtcggtctgcgaatggcataaggaaagttacggccagtcaccggccacaatttatgaagcggtgcagggtaatcctgctctgcgcggcattgcgggacctattaaccttaacacggtgcacttcttcgaggatgtaagcaccggactggtaccgttatccgaactgggtcgggcagtgaatgtgcctaccccacttatcgatgctgttcttgacttgatcagttcgctgatagacacggatttcagaaaggaaggtcgtaccttggaaaaattaggtctgagcggacttaccgccgcgggcataagaagtgctgttgag

SEQ ID NO: 122 - protein, 359 aa, Artificial Sequence
  Engineered variant of opine dehydrogenase CENDH
MIESKTYAVLGLGNGGHAFAAYLALKGQSVLAWDIDAQRIKEIQDRGAIIAEGPGLAGTAHPDLLTSDIGLAVKDADVILIVVPAIHHASIAANIASYISEGQLIILNPGATGGALEFRKILRENGAPEVTIGETSSMLFTCRSERPGQVTVNAITLAMDFACLPAAKAGWALEQIGSVLPQYVAVENVLHTSLTNIEAVLHPLPTLLNAARCESGTPFQYYLEGITPSVGSLAEKVDAERIAIAKAFDLNVPSVCEWHKESYGQSPATIYEAVQGNPALRGIAGPINLNTVHFFEDVSTGLVPLSELGRAVNVPTPLIDAVLDLISSLIDTDFRKEGRTLEKLGLSGLTAAGIRSAVE

SEQ ID NO: 123 - DNA, 1077 bp, Artificial Sequence
  Engineered variant of opine dehydrogenase CENDH
atgatcgagtcaaaaacatacgccgttttgggattaggaaacgggggtcacgcatttgccgcctatttagcattgaagggccagagtgtactggcttgggacatcgatgctcagagaatcaaagagattcaggaccgtggagccatcatagcggaaggaccaggacttgctgggactgctcacccggatcttctgacctcagatataggtttggcggttaaagacgctgatgtgatactgattgtagtgccggccatccaccacgcttccattgcagcaaatatcgccagttacatttccgagggtcagttgattatccttaaccctggggcaacgggtggagcgctggaattccggaaaatcctgcgtgaaaatggtgcgccggaggtaacgatcggggaaacctcaagtatgctctttacatgccgctccgagagaccaggacaggttacggtaaatgcgataacaaatgccatggactttgcatgtctcccagcggcaaaagctggatgggccctggaacagatagggtcggttcttcctcaatacgtggctgtcgaaaacgtgttgcatacttcgctgactaatatcgaagctgtattgcacccgctgccaacactgttaaacgctgctcgttgtgagtctggtaccccattccaatattatctggaggggattacgccatcagtcgggagtcttgcggagaaagtggacgctgaacgcatagcaatcgcaaaggctttcgatttaaacgttccgtcggtctgcgaatggcataaggaaagttacggccagtcaccggccacaatttatgaagcggtgcagggtaatcctgctctgcgcggcattgcgggacctattaaccttaacacggtgcacttcttcgaggatgtaagcaccggactggtaccgttatccgaactgggtcgggcagtgaatgtgcctaccccacttatcgatgctgttcttgacttgatcagttcgctgatagacacggatttcagaaaggaaggtcgtaccttggaaaaattaggtctgagcggacttaccgccgcgggcataagaagtgctgttgag

SEQ ID NO: 124 - protein, 359 aa, Artificial Sequence
  Engineered variant of opine dehydrogenase CENDH
MIESKTYAVLGLGNGGHAFAAYLALKGQSVLAWDIDAQRIKEIQDRGAIIAEGPGLAGTAHPDLLTSDIGLAVKDADVILIVVPAIHHASIAANIASYISEGQLIILNPGATGGALEFRKILRENGAPEVTIGETSSMLFTCRSERPGQVTVNAITNAMDFACLPAAKAGWALEQIGSVLPQYVAVENVLHTSLTNIEAVLHPLPTLLNAARCESGTPFQYYLEGITPSVGSLAEKVDAERIAIAKAFDLNVPSVCEWHKESYGQSPATIYEAVQGNPALRGIAGPINLNTVHFFEDVSTGLVPLSELGRAVNVPTPLIDAVLDLISSLIDTDFRKEGRTLEKLGLSGLTAAGIRSAVE

SEQ ID NO: 125 - DNA, 1077 bp, Artificial Sequence
  Engineered variant of opine dehydrogenase CENDH
atgatcgagtcaaaaacatacgccgttttgggattaggaaacgggggtcacgcatttgccgcctatttagcattgaagggccagagtgtactggcttgggacatcgatgctcagagaatcaaagagattcaggaccgtggagccatcatagcggaaggaccaggacttgctgggactgctcacccggatcttctgacctcagatataggtttggcggttaaagacgctgatgtgatactgattgtagtgccggccatccaccacgcttccattgcagcaaatatcgccagttacatttccgagggtcagttgattatccttaaccctggggcaacgggtggagcgctggaattccggaaaatcctgcgtgaaaatggtgcgccggaggtaacgatcggggaaacctcaagtatgctctttacatgccgctccgagagaccaggacaggttacggtaaatgcgataacaggcgccatggactttgcatgtctcccagcggcaaaagctggatgggccctggaacagatagggtcggttcttcctcaatacgtggctgtcgaaaacgtgttgcatacttcgctgactaatatcgaagctgtattgcacccgctgccaacactgttaaacgctgctcgttgtgagtctggtaccccattccaatattatctggaggggattacgccatcagtcggggctcttgcggagaaagtggacgctgaacgcatagcaatcgcaaaggctttcgatttaaacgttccgtcggtctgcgaatggcataaggaaagttacggccagtcaccggccacaatttatgaagcggtgcagggtaatcctgctctgcgcggcattgcgggacctattaaccttaacacggtgcacttcttcgaggatgtaagcaccggactggtaccgttatccgaactgggtcgggcagtgaatgtgcctaccccacttatcgatgctgttcttgacttgatcagttcgctgatagacacggatttcagaaaggaaggtcgtaccttggaaaaattaggtctgagcggacttaccgccgcgggcataagaagtgctgttgag

SEQ ID NO: 126 - protein, 359 aa, Artificial Sequence
  Engineered variant of opine dehydrogenase CENDH
MIESKTYAVLGLGNGGHAFAAYLALKGQSVLAWDIDAQRIKEIQDRGAIIAEGPGLAGTAHPDLLTSDIGLAVKDADVILIVVPAIHHASIAANIASYISEGQLIILNPGATGGALEFRKILRENGAPEVTIGETSSMLFTCRSERPGQVTVNAITGAMDFACLPAAKAGWALEQIGSVLPQYVAVENVLHTSLTNIEAVLHPLPTLLNAARCESGTPFQYYLEGITPSVGALAEKVDAERIAIAKAFDLNVPSVCEWHKESYGQSPATIYEAVQGNPALRGIAGPINLNTVHFFEDVSTGLVPLSELGRAVNVPTPLIDAVLDLISSLIDTDFRKEGRTLEKLGLSGLTAAGIRSAVE

SEQ ID NO: 127 - DNA, 1077 bp, Artificial Sequence
  Engineered variant of opine dehydrogenase CENDH
atgatcgagtcaaaaacatacgccgttttgggattaggaaacgggggtcacgcatttgccgcctatttagcattgaagggccagagtgtactggcttgggacatcgatgctcagagaatcaaagagattcaggaccgtggagccatcatagcggaaggaccaggacttgctgggactgctcacccggatcttctgacctcagatataggtttggcggttaaagacgctgatgtgatactgattgtagtgccggccatccaccacgcttccattgcagcaaatatcgccagttacatttccgagggtcagttgattatccttaaccctggggcaacgggtggagcgctggaattccggaaaatcctgcgtgaaaatggtgcgccggaggtaacgatcggggaaacctcaagtatgctctttacatgccgctccgagagaccaggacaggttacggtaaatgcgataacaggcgccatggactttgcatgtctcccagcggcaaaagctggatgggccctggaacagatagggtcggttcttcctcaatacgtggctgtcgaaaacgtgttgcatacttcgctgactaatatcgaagctgtattgcacccgctgccaacactgttaaacgctgctcgttgtgagtctggtaccccattccaatattatctggaggggattacgccatcagtcgggagtcttgcggagaaagtggacgctgaacgcatagcaatcgcaaaggctttcgatttaaacgttccgtcggtctgcgaatggcataaggaaagttacggccagtcaccggccacaatttatgaagcggtgcagggtaatcctgctctgcgcggcattgcgggacctattgggcttaacacggtgcacttcttcgaggatgtaagcaccggactggtaccgttatccgaactgggtcgggcagtgaatgtgcctaccccacttatcgatgctgttcttgacttgatcagttcgctgatagacacggatttcagaaaggaaggtcgtaccttggaaaaattaggtctgagcggacttaccgccgcgggcataagaagtgctgttgag

SEQ ID NO: 128 - protein, 359 aa, Artificial Sequence
  Engineered variant of opine dehydrogenase CENDH
MIESKTYAVLGLGNGGHAFAAYLALKGQSVLAWDIDAQRIKEIQDRGAIIAEGPGLAGTAHPDLLTSDIGLAVKDADVILIVVPAIHHASIAANIASYISEGQLIILNPGATGGALEFRKILRENGAPEVTIGETSSMLFTCRSERPGQVTVNAITGAMDFACLPAAKAGWALEQIGSVLPQYVAVENVLHTSLTNIEAVLHPLPTLLNAARCESGTPFQYYLEGITPSVGSLAEKVDAERIAIAKAFDLNVPSVCEWHKESYGQSPATIYEAVQGNPALRGIAGPIGLNTVHFFEDVSTGLVPLSELGRAVNVPTPLIDAVLDLISSLIDTDFRKEGRTLEKLGLSGLTAAGIRSAVE

SEQ ID NO: 129 - DNA, 1077 bp, Artificial Sequence
  Engineered variant of opine dehydrogenase CENDH
atgatcgagtcaaaaacatacgccgttttgggattaggaaacgggggtcacgcatttgccgcctatttagcattgaagggccagagtgtactggcttgggacatcgatgctcagagaatcaaagagattcaggaccgtggagccatcatagcggaaggaccaggacttgctgggactgctcacccggatcttctgacctcagatataggtttggcggttaaagacgctgatgtgatactgattgtagtgccggccatccaccacgcttccattgcagcaaatatcgccagttacatttccgagggtcagttgattatccttaaccctggggcaacgggtggagcgctggaattccggaaaatcctgcgtgaaaatggtgcgccggaggtaacgatcggggaaacctcaagtatgctctttacatgccgctccgagagaccaggacaggttacggtaaatgcgataacaggcgccatggactttgcatgtctcccagcggcaaaagctggatgggccctggaacagatagggtcggttcttcctcaatacgtggctgtcgaaaacgtgttgcatacttcgctgactaatatcgaagctgtattgcacccgctgccaacactgttaaacgctgctcgttgtgagtctggtaccccattcgattattatctggaggggattacgccatcagtcgggagtcttgcggagaaagtggacgctgaacgcatagcaatcgcaaaggctttcgatttaaacgttccgtcggtctgcgaatggcataaggaaagttacggccagtcaccggccacaatttatgaagcggtgcagggtaatcctgctctgcgcggcattgcgggacctattaaccttaacacggtgcacttcttcgaggatgtaagcaccggactggtaccgttatccgaactgggtcgggcagtgaatgtgcctaccccacttatcgatgctgttcttgacttgatcagttcgctgatagacacggatttcagaaaggaaggtcgtaccttggaaaaattaggtctgagcggacttaccgccgcgggcataagaagtgctgttgag

SEQ ID NO: 130 - protein, 359 aa, Artificial Sequence
  Engineered variant of opine dehydrogenase CENDH
MIESKTYAVLGLGNGGHAFAAYLALKGQSVLAWDIDAQRIKEIQDRGAIIAEGPGLAGTAHPDLLTSDIGLAVKDADVILIVVPAIHHASIAANIASYISEGQLIILNPGATGGALEFRKILRENGAPEVTIGETSSMLFTCRSERPGQVTVNAITGAMDFACLPAAKAGWALEQIGSVLPQYVAVENVLHTSLTNIEAVLHPLPTLLNAARCESGTPFDYYLEGITPSVGSLAEKVDAERIAIAKAFDLNVPSVCEWHKESYGQSPATIYEAVQGNPALRGIAGPINLNTVHFFEDVSTGLVPLSELGRAVNVPTPLIDAVLDLISSLIDTDFRKEGRTLEKLGLSGLTAAGIRSAVE

SEQ ID NO: 131 - DNA, 1077 bp, Artificial Sequence
  Engineered variant of opine dehydrogenase CENDH
atgatcgagtcaaaaacatacgccgttttgggattaggaaacgggggtcacgcatttgccgcctatttagcattgaagggccagagtgtactggcttgggacatcgatgctcagagaatcaaagagattcaggaccgtggagccatcatagcggaaggaccaggacttgctgggactgctcacccggatcttctgacctcagatataggtttggcggttaaagacgctgatgtgatactgattgtagtgccggccatccaccacgcttccattgcagcaaatatcgccagttacatttccgagggtcagttgattatccttaaccctggggcaacgggtggagcgctggaattccggaaaatcctgcgtgaaaatggtgcgccggaggtaacgatcggggaaacctcaagtatgctctttacatgccgctccgagagaccaggacaggttacggtaaatgcgataacaggcgccatggactttgcatgtctcccagcggcaaaagctggatgggccctggaacagatagggtcggttcttcctcaatacgtggctgtcgaaaacgtgttgcatacttcgctgactaatatcgaagctgtattgcacccgctgccaacactgttaaacgctgctcgttgtgagtctggtaccccattccaatattatctggaggggattacgccatcagtcgggagtcttgcggagaaagtggacgctgaacgcatagcaatcgcaaaggctttcgatttaaacgttccgtcggtctgcgaatggcataaggaaagttacggccagtcaccggccacaatttatgaagcggtgcagggtaatcctgctctgcgcggcattctgggacctattaaccttaacacggtgcacttcttcgaggatgtaagcaccggactggtaccgttatccgaactgggtcgggcagtgaatgtgcctaccccacttatcgatgctgttcttgacttgatcagttcgctgatagacacggatttcagaaaggaaggtcgtaccttggaaaaattaggtctgagcggacttaccgccgcgggcataagaagtgctgttgag

SEQ ID NO: 132 - protein, 359 aa, Artificial Sequence
  Engineered variant of opine dehydrogenase CENDH
MIESKTYAVLGLGNGGHAFAAYLALKGQSVLAWDIDAQRIKEIQDRGAIIAEGPGLAGTAHPDLLTSDIGLAVKDADVILIVVPAIHHASIAANIASYISEGQLIILNPGATGGALEFRKILRENGAPEVTIGETSSMLFTCRSERPGQVTVNAITGAMDFACLPAAKAGWALEQIGSVLPQYVAVENVLHTSLTNIEAVLHPLPTLLNAARCESGTPFQYYLEGITPSVGSLAEKVDAERIAIAKAFDLNVPSVCEWHKESYGQSPATIYEAVQGNPALRGILGPINLNTVHFFEDVSTGLVPLSELGRAVNVPTPLIDAVLDLISSLIDTDFRKEGRTLEKLGLSGLTAAGIRSAVE

SEQ ID NO: 133 - DNA, 1077 bp, Artificial Sequence
  Engineered variant of opine dehydrogenase CENDH
atgatcgagtcaaaaacatacgccgttttgggattaggaaacgggggtcacgcatttgccgcctatttagcattgaagggccagagtgtactggcttgggacatcgatgctcagagaatcaaagagattcaggaccgtggagccatcatagcggaaggaccaggacttgctgggactgctcacccggatcttctgacctcagatataggtttggcggttaaagacgctgatgtgatactgattgtagtgccggccatccaccacgcttccattgcagcaaatatcgccagttacatttccgagggtcagttgattatccttaaccctggggcaacgggtggagcgctggaattccggaaaatcctgcgtgaaaatggtgcgccggaggtaacgatcggggaaacctcaagtatgctctttacatgccgctccgagagaccaggacaggttacggtaaatgcgataacaggcgccatggactttgcatgtctcccagcggcaaaagctggatgggccctggaacagatagggtcggttcttcctcaatacgtggctgtcgaaaacgtgttgcatacttcgctgactaatatcgaagctgtattgcacccgctgccaacactgttaaacgctgctcgttgtgagtctggtaccccattccaatattatacggaggggattacgccatcagtcgggagtcttgcggagaaagtggacgctgaacgcatagcaatcgcaaaggctttcgatttaaacgttccgtcggtctgcgaatggcataaggaaagttacggccagtcaccggccacaatttatgaagcggtgcagggtaatcctgctctgcgcggcattgcgggacctattaaccttaacacggtgcacttcttcgaggatgtaagcaccggactggtaccgttatccgaactgggtcgggcagtgaatgtgcctaccccacttatcgatgctgttcttgacttgatcagttcgctgatagacacggatttcagaaaggaaggtcgtaccttggaaaaattaggtctgagcggacttaccgccgcgggcataagaagtgctgttgag

SEQ ID NO: 134 - protein, 359 aa, Artificial Sequence
  Engineered variant of opine dehydrogenase CENDH
MIESKTYAVLGLGNGGHAFAAYLALKGQSVLAWDIDAQRIKEIQDRGAIIAEGPGLAGTAHPDLLTSDIGLAVKDADVILIVVPAIHHASIAANIASYISEGQLIILNPGATGGALEFRKILRENGAPEVTIGETSSMLFTCRSERPGQVTVNAITGAMDFACLPAAKAGWALEQIGSVLPQYVAVENVLHTSLTNIEAVLHPLPTLLNAARCESGTPFQYYTEGITPSVGSLAEKVDAERIAIAKAFDLNVPSVCEWHKESYGQSPATIYEAVQGNPALRGIAGPINLNTVHFFEDVSTGLVPLSELGRAVNVPTPLIDAVLDLISSLIDTDFRKEGRTLEKLGLSGLTAAGIRSAVE

SEQ ID NO: 135 - DNA, 1077 bp, Artificial Sequence
  Engineered variant of opine dehydrogenase CENDH
atgatcgagtcaaaaacatacgccgttttgggattaggaaacgggggtcacgcatttgccgcctatttagcattgaagggccagagtgtactggcttgggacatcgatgctcagagaatcaaagagattcaggaccgtggagccatcatagcggaaggaccaggacttgctgggactgctcacccggatcttctgacctcagatataggtttggcggttaaagacgctgatgtgatactgattgtagtgccggccatccaccacgcttccattgcagcaaatatcgccagttacatttccgagggtcagttgattatccttaaccctggggcaacgggtggagcgctggaattccggaaaatcctgcgtgaaaatggtgcgccggaggtaacgatcggggaaacctcaagtatgctctttacatgccgctccgagagaccaggacaggttacggtaaatgcgataacaggcgccatggactttgcatgtctcccagcggcaaaagctggatgggccctggaacagatagggtcggttcttcctcaatacgtggctgtcgaaaacgtgttgcatacttcgctgactaatatcgaagctgtattgcacccgctgccaacactgttaaacgctgctcgttgtgagtctggtaccccattccaatattatctggaggggattacgccatcagtcgggagtcttgcggagaaagtggacgctgaacgcatagcaatcgcaaaggctttcgatttaaacgttccgtcggtctgcgaatggcataaggcgagttacggccagtcaccggccacaatttatgaagcggtgcagggtaatcctgctctgcgcggcattgcgggacctattaaccttaacacggtgcacttcttcgaggatgtaagcaccggactggtaccgttatccgaactgggtcgggcagtgaatgtgcctaccccacttatcgatgctgttcttgacttgatcagttcgctgatagacacggatttcagaaaggaaggtcgtaccttggaaaaattaggtctgagcggacttaccgccgcgggcataagaagtgctgttgag

SEQ ID NO: 136 - protein, 359 aa, Artificial Sequence
  Engineered variant of opine dehydrogenase CENDH
MIESKTYAVLGLGNGGHAFAAYLALKGQSVLAWDIDAQRIKEIQDRGAIIAEGPGLAGTAHPDLLTSDIGLAVKDADVILIVVPAIHHASIAANIASYISEGQLIILNPGATGGALEFRKILRENGAPEVTIGETSSMLFTCRSERPGQVTVNAITGAMDFACLPAAKAGWALEQIGSVLPQYVAVENVLHTSLTNIEAVLHPLPTLLNAARCESGTPFQYYLEGITPSVGSLAEKVDAERIAIAKAFDLNVPSVCEWHKASYGQSPATIYEAVQGNPALRGIAGPINLNTVHFFEDVSTGLVPLSELGRAVNVPTPLIDAVLDLISSLIDTDFRKEGRTLEKLGLSGLTAAGIRSAVE

SEQ ID NO: 137 - DNA, 1077 bp, Artificial Sequence
  Engineered variant of opine dehydrogenase CENDH
atgatcgagtcaaaaacatacgccgttttgggattaggaaacgggggtcacgcatttgccgcctatttagcattgaagggccagagtgtactggcttgggacatcgatgctcagagaatcaaagagattcaggaccgtggagccatcatagcggaaggaccaggacttgctgggactgctcacccggatcttctgacctcagatataggtttggcggttaaagacgctgatgtgatactgattgtagtgccggccatccaccacgcttccattgcagcaaatatcgccagttacatttccgagggtcagttgattatccttaaccctggggcaacgggtggagcgctggaattccggaaaatcctgcgtgaaaatggtgcgccggaggtaacgatcggggaaacctcaagtatgctctttacatgccgctccgagagaccaggacaggttacggtaaatgcgataacaggcgccatggactttgcatgtctcccagcggcaaaagctggatgggccctggaacagatagggtcggttcttcctcaatacgtggctgtcgaaaacgtgttgcatacttcgctgactaatatcgaagctgtattgcacccgctgccaacactgttaaacgctgctcgttgtgagtctggtaccccattccaatattatctggaggggattacgccatcagtcgggagtcttgcggagaaagtggacgctgaacgcataggtatcgcaaaggctttcgatttaaacgttccgtcggtctgcgaatggcataaggaaagttacggccagtcaccggccacaatttatgaagcggtgcagggtaatcctgctctgcgcggcattgcgggacctattaaccttaacacggtgcacgtcttcgaggatgtaagcaccggactggtaccgttatccgaactgggtcgggcagtgaatgtgcctaccccacttatcgatgctgttcttgacttgatcagttcgctgatagacacggatttcagaaaggaaggtcgtaccttggaaaaattaggtctgagcggacttaccgccgcgggcataagaagtgctgttgag

SEQ ID NO: 138 - protein, 359 aa, Artificial Sequence
  Engineered variant of opine dehydrogenase CENDH
MIESKTYAVLGLGNGGHAFAAYLALKGQSVLAWDIDAQRIKEIQDRGAIIAEGPGLAGTAHPDLLTSDIGLAVKDADVILIVVPAIHHASIAANIASYISEGQLIILNPGATGGALEFRKILRENGAPEVTIGETSSMLFTCRSERPGQVTVNAITGAMDFACLPAAKAGWALEQIGSVLPQYVAVENVLHTSLTNIEAVLHPLPTLLNAARCESGTPFQYYLEGITPSVGSLAEKVDAERIGIAKAFDLNVPSVCEWHKESYGQSPATIYEAVQGNPALRGIAGPINLNTVHVFEDVSTGLVPLSELGRAVNVPTPLIDAVLDLISSLIDTDFRKEGRTLEKLGLSGLTAAGIRSAVE

SEQ ID NO: 139 - DNA, 1077 bp, Artificial Sequence
  Engineered variant of opine dehydrogenase CENDH
atgatcgagtcaaaaacatacgccgttttgggattaggaaacgggggtcacgcatttgccgcctatttagcattgaagggccagagtgtactggcttgggacatcgatgctcagagaatcaaagagattcaggaccgtggagccatcatagcggaaggaccaggacttgctgggactgctcacccggatcttctgacctcagatataggtttggcggttaaagacgctgatgtgatactgattgtagtgccggccatccaccacgcttccattgcagcaaatatcgccagttacatttccgagggtcagttgattatccttaaccctggggcaacgggtggagcgctggaattccggaaaatcctgcgtgaaaatggtgcgccggaggtaacgatcggggaaacctcaagtatgctctttacatgccgctccgagagaccaggacaggttacggtaaatgcgataacaggcgccatggactttgcatgtctcccagcggcaaaagctggatgggccctggaacagatagggtcggttcttcctcaatacgtggctgtcgaaaacgtgttgcatacttcgctgactaatatcgaagctgtattgcacccgctgccaacactgttaaacgctgctcgttgtgagtctggtaccccattccaatattatctggaggggattacgccatcagtcgggagtcttgcggagaaagtggacgctgaacgcatagcaatcgcaaaggctttcgatttaaacgttccgtcggtctgcgaatggcataaggaaagttacggccagtcaccggccacaatttatgaagcggtgcagggtaatcctgctctgcgcggcattgcgggacctatttcgcttaacacggtgcacttcttcgaggatgtaagcaccggactggtaccgttatccgaactgggtcgggcagtgaatgtgcctaccccacttatcgatgctgttcttgacttgatcagttcgctgatagacacggatttcagaaaggaaggtcgtaccttggaaaaattaggtctgagcggacttaccgccgcgggcataagaagtgctgttgag

SEQ ID NO: 140 - protein, 359 aa, Artificial Sequence
  Engineered variant of opine dehydrogenase CENDH
MIESKTYAVLGLGNGGHAFAAYLALKGQSVLAWDIDAQRIKEIQDRGAIIAEGPGLAGTAHPDLLTSDIGLAVKDADVILIVVPAIHHASIAANIASYISEGQLIILNPGATGGALEFRKILRENGAPEVTIGETSSMLFTCRSERPGQVTVNAITGAMDFACLPAAKAGWALEQIGSVLPQYVAVENVLHTSLTNIEAVLHPLPTLLNAARCESGTPFQYYLEGITPSVGSLAEKVDAERIAIAKAFDLNVPSVCEWHKESYGQSPATIYEAVQGNPALRGIAGPISLNTVHFFEDVSTGLVPLSELGRAVNVPTPLIDAVLDLISSLIDTDFRKEGRTLEKLGLSGLTAAGIRSAVE

SEQ ID NO: 141 - DNA, 1077 bp, Artificial Sequence
  Engineered variant of opine dehydrogenase CENDH
atgatcgagtcaaaaacatacgccgttttgggattaggaaacgggggtcacgcatttgccgcctatttagcattgaagggccagagtgtactggcttgggacatcgatgctcagagaatcaaagagattcaggaccgtggagccatcatagcggaaggaccaggacttgctgggactgctcacccggatcttctgacctcagatataggtttggcggttaaagacgctgatgtgatactgattgtagtgccggccatccaccacgcttccattgcagcaaatatcgccagttacatttccgagggtcagttgattatccttaaccctggggcaacgggtggagcgctggaattccggaaaatcctgcgtgaaaatggtgcgccggaggtaacgatcggggaaacctcaagtatgctctttacatgccgctccgagagaccaggacaggttacggtaaatgcgataacaatggccatggactttgcatgtctcccagcggcaaaagctggatgggccctggaacagatagggtcggttcttcctcaatacgtggctgtcgaaaacgtgttgcatacttcgctgactaatatcgaagctgtattgcacccgctgccaacactgttaaacgctgctcgttgtgagtctggtaccccattccaatattatctggaggggattacgccatcagtcgggagtcttgcggagaaagtggacgctgaacgcatagcaatcgcaaaggctttcgatttaaacgttccgtcggtctgcgaatggcataaggaaagttacggccagtcaccggccacaatttatgaagcggtgcagggtaatcctgctctgcgcggcattgcgggacctattaaccttaacacggtgcacttcttcgaggatgtaagcaccggactggtaccgttatccgaactgggtcgggcagtgaatgtgcctaccccacttatcgatgctgttcttgacttgatcagttcgctgatagacacggatttcagaaaggaaggtcgtaccttggaaaaattaggtctgagcggacttaccgccgcgggcataagaagtgctgttgag

SEQ ID NO: 142 - protein, 359 aa, Artificial Sequence
  Engineered variant of opine dehydrogenase CENDH
MIESKTYAVLGLGNGGHAFAAYLALKGQSVLAWDIDAQRIKEIQDRGAIIAEGPGLAGTAHPDLLTSDIGLAVKDADVILIVVPAIHHASIAANIASYISEGQLIILNPGATGGALEFRKILRENGAPEVTIGETSSMLFTCRSERPGQVTVNAITMAMDFACLPAAKAGWALEQIGSVLPQYVAVENVLHTSLTNIEAVLHPLPTLLNAARCESGTPFQYYLEGITPSVGSLAEKVDAERIAIAKAFDLNVPSVCEWHKESYGQSPATIYEAVQGNPALRGIAGPINLNTVHFFEDVSTGLVPLSELGRAVNVPTPLIDAVLDLISSLIDTDFRKEGRTLEKLGLSGLTAAGIRSAVE

SEQ ID NO: 143 - DNA, 1077 bp, Artificial Sequence
  Engineered variant of opine dehydrogenase CENDH
atgatcgagtcaaaaacatacgccgttttgggattaggaaacgggggtcacgcatttgccgcctatttagcattgaagggccagagtgtactggcttgggacatcgatgctcagagaatcaaagagattcaggaccgtggagccatcatagcggaaggaccaggacttgctgggactgctcacccggatcttctgacctcagatataggtttggcggttaaagacgctgatgtgatactgattgtagtgccggccatccaccacgcttccattgcagcaaatatcgccagttacatttccgagggtcagttgattatccttaaccctggggcaacgggtggagcgctggaattccggaaaatcctgcgtgaaaatggtgcgccggaggtaacgatcggggaaacctcaagtatgctctttacatgccgctccgagagaccaggacaggttacggtaaatgcgataacaggcgccatggactttgcatgtctcccagcggcaaaagctggatgggccctggaacagatagggtcggttcttcctcaatacgtggctgtcgaaaacgtgttgcatacttcgctgactaatatcgaagctgtattgcacccgctgccaacactgttaaacgctgctcgttgtgagtctggtaccccattccaatattatctggaggggattacgccatcagtcgggagtcttgcggagaaagtggacgctgaacgcatagcaatcgcaaaggctttcgatttaaacgttccgtcggtctgcgaatggcataaggaaagttacggccagtcaccggccacaatttatgaagcggtgcagggtaatcctgctctgcgcggcattgcgggacctacgaaccttaacacggtgcacttcttcgaggatgtaagcaccggactggtaccgttatccgaactgggtcgggcagtgaatgtgcctaccccacttatcgatgctgttcttgacttgatcagttcgctgatagacacggatttcagaaaggaaggtcgtaccttggaaaaattaggtctgagcggacttaccgccgcgggcataagaagtgctgttgag

SEQ ID NO: 144 - protein, 359 aa, Artificial Sequence
  Engineered variant of opine dehydrogenase CENDH
MIESKTYAVLGLGNGGHAFAAYLALKGQSVLAWDIDAQRIKEIQDRGAIIAEGPGLAGTAHPDLLTSDIGLAVKDADVILIVVPAIHHASIAANIASYISEGQLIILNPGATGGALEFRKILRENGAPEVTIGETSSMLFTCRSERPGQVTVNAITGAMDFACLPAAKAGWALEQIGSVLPQYVAVENVLHTSLTNIEAVLHPLPTLLNAARCESGTPFQYYLEGITPSVGSLAEKVDAERIAIAKAFDLNVPSVCEWHKESYGQSPATIYEAVQGNPALRGIAGPTNLNTVHFFEDVSTGLVPLSELGRAVNVPTPLIDAVLDLISSLIDTDFRKEGRTLEKLGLSGLTAAGIRSAVE

SEQ ID NO: 145 - DNA, 1077 bp, Artificial Sequence
  Engineered variant of opine dehydrogenase CENDH
atgatcgagtcaaaaacatacgccgttttgggattaggaaacgggggtcacgcatttgccgcctatttagcattgaagggccagagtgtactggcttgggacatcgatgctcagagaatcaaagagattcaggaccgtggagccatcatagcggaaggaccaggacttgctgggactgctcacccggatcttctgacctcagatataggtttggcggttaaagacgctgatgtgatactgattgtagtgccggccatccaccacgcttccattgcagcaaatatcgccagttacatttccgagggtcagttgattatccttaaccctggggcaacgggtggagcgctggaattccggaaaatcctgcgtgaaaatggtgcgccggaggtaacgatcggggaaacctcaagtatgctctttacatgccgctccgagagaccaggacaggttacggtaaatgcgataacaggcgccatggactttgcatgtctcccagcggcaaaagctggatgggccctggaacagatagggtcggttcttcctcaatacaaggctgtcgaaaacgtgttgcatacttcgctgactaatatcgaagctgtattgcacccgctgccaacactgttaaacgctgctcgttgtgagtctggtaccccattccaatattatctggaggggattacgccatcagtcgggagtcttgcggagaaagtggacgctgaacgcatagcaatcgcaaaggctttcgatttaaacgttccgtcggtctgcgaatggcataaggaaagttacggccagtcaccggccacaatttatgaagcggtgcagggtaatcctgctctgcgcggcattgcgggacctattaaccttaacacggtgcacttcttcgaggatgtaagcaccggactggtaccgttatccgaactgggtcgggcagtgaatgtgcctaccccacttatcgatgctgttcttgacttgatcagttcgctgatagacacggatttcagaaaggaaggtcgtaccttggaaaaattaggtctgagcggacttaccgccgcgggcataagaagtgctgttgag

SEQ ID NO: 146 - protein, 359 aa, Artificial Sequence
  Engineered variant of opine dehydrogenase CENDH
MIESKTYAVLGLGNGGHAFAAYLALKGQSVLAWDIDAQRIKEIQDRGAIIAEGPGLAGTAHPDLLTSDIGLAVKDADVILIVVPAIHHASIAANIASYISEGQLIILNPGATGGALEFRKILRENGAPEVTIGETSSMLFTCRSERPGQVTVNAITGAMDFACLPAAKAGWALEQIGSVLPQYKAVENVLHTSLTNIEAVLHPLPTLLNAARCESGTPFQYYLEGITPSVGSLAEKVDAERIAIAKAFDLNVPSVCEWHKESYGQSPATIYEAVQGNPALRGIAGPINLNTVHFFEDVSTGLVPLSELGRAVNVPTPLIDAVLDLISSLIDTDFRKEGRTLEKLGLSGLTAAGIRSAVE

SEQ ID NO: 147 - DNA, 1077 bp, Artificial Sequence
  Engineered variant of opine dehydrogenase CENDH
atgatcgagtcaaaaacatacgccgttttgggattaggaaacgggggtcacgcatttgccgcctatttagcattgaagggccagagtgtactggcttgggacatcgatgctcagagaatcaaagagattcaggaccgtggagccatcatagcggaaggaccaggacttgctgggactgctcacccggatcttctgacctcagatataggtttggcggttaaagacgctgatgtgatactgattgtagtgccggccatccaccacgcttccattgcagcaaatatcgccagttacatttccgagggtcagttgattatccttaaccctggggcaacgggtggagcgctggaattccggaaaatcctgcgtgaaaatggtgcgccggaggtaacgatcggggaaacctcaagtatgctctttacatgccgctccgagagaccaggacaggttacggtaaatgcgataacaggcgccatggactttgcatgtctcccagcggcaaaagctggatgggccctggaacagatagggtcggttcttcctcaatacgtggctgtcgaaaacgtgttgcatacttcgctgactaatatcgaagctgtattgcacccgctgccaacactgttaaacgctgctcgttgtgagtctggtaccccattccaatattatctggaggggattacgccatcagtcgggagtcttgcggagaaagtggacgctgaacgcatagcaatcgcaaaggctttcgatttaaacgttccgtcggtctgcgaatggcataaggaaagttacggccagtcaccggccacaatttatgaagcggtgcagggtaatcctgctctgcgcggcatttatggacctattaaccttaacacggtgcacttcttcgaggatgtaagcaccggactggtaccgttatccgaactgggtcgggcagtgaatgtgcctaccccacttatcgatgctgttcttgacttgatcagttcgctgatagacacggatttcagaaaggaaggtcgtaccttggaaaaattaggtctgagcggacttaccgccgcgggcataagaagtgctgttgag

SEQ ID NO: 148 - protein, 359 aa, Artificial Sequence
  Engineered variant of opine dehydrogenase CENDH
MIESKTYAVLGLGNGGHAFAAYLALKGQSVLAWDIDAQRIKEIQDRGAIIAEGPGLAGTAHPDLLTSDIGLAVKDADVILIVVPAIHHASIAANIASYISEGQLIILNPGATGGALEFRKILRENGAPEVTIGETSSMLFTCRSERPGQVTVNAITGAMDFACLPAAKAGWALEQIGSVLPQYVAVENVLHTSLTNIEAVLHPLPTLLNAARCESGTPFQYYLEGITPSVGSLAEKVDAERIAIAKAFDLNVPSVCEWHKESYGQSPATIYEAVQGNPALRGIYGPINLNTVHFFEDVSTGLVPLSELGRAVNVPTPLIDAVLDLISSLIDTDFRKEGRTLEKLGLSGLTAAGIRSAVE

SEQ ID NO: 149 - DNA, 1077 bp, Artificial Sequence
  Engineered variant of opine dehydrogenase CENDH
atgatcgagtcaaaaacatacgccgttttgggattaggaaacgggggtcacgcatttgccgcctatttagcattgaagggccagagtgtactggcttgggacatcgatgctcagagaatcaaagagattcaggaccgtggagccatcatagcggaaggaccaggacttgctgggactgctcacccggatcttctgacctcagatataggtttggcggttaaagacgctgatgtgatactgattgtagtgccggccatccaccacgcttccattgcagcaaatatcgccagttacatttccgagggtcagttgattatccttaaccctggggcaacgggtggagcgctggaattccggaaaatcctgcgtgaaaatggtgcgccggaggtaacgatcggggaaacctcaagtatgctctttacatgccgctccgagagaccaggacaggttacggtaaatgcgataacaggcgccatggactttgcatgtctcccagcggcaaaagctggatgggccctggaacagatagggtcggttcttcctcaatacgtggctgtcgaaaacgtgttgcatacttcgctgactaatatcgaagctgtattgcacccgctgccaacactgttaaacgctgctcgttgtgagtctggtaccccattccaatattatctggaggggattacgccatcagtcgggagtcttgcggagaaagtggacgctgaacgcatagcaatcgcaaaggctttcgatttaaacgttccgtcggtctgcgaatggcataagaagagttacggccagtcaccggccacaatttatgaagcggtgcagggtaatcctgctctgcgcggcattgcgggacctattaaccttaacacggtgcacttcttcgaggatgtaagcaccggactggtaccgttatccgaactgggtcgggcagtgaatgtgcctaccccacttatcgatgctgttcttgacttgatcagttcgctgatagacacggatttcagaaaggaaggtcgtaccttggaaaaattaggtctgagcggacttaccgccgcgggcataagaagtgctgttgag

SEQ ID NO: 150 - protein, 359 aa, Artificial Sequence
  Engineered variant of opine dehydrogenase CENDH
MIESKTYAVLGLGNGGHAFAAYLALKGQSVLAWDIDAQRIKEIQDRGAIIAEGPGLAGTAHPDLLTSDIGLAVKDADVILIVVPAIHHASIAANIASYISEGQLIILNPGATGGALEFRKILRENGAPEVTIGETSSMLFTCRSERPGQVTVNAITGAMDFACLPAAKAGWALEQIGSVLPQYVAVENVLHTSLTNIEAVLHPLPTLLNAARCESGTPFQYYLEGITPSVGSLAEKVDAERIAIAKAFDLNVPSVCEWHKKSYGQSPATIYEAVQGNPALRGIAGPINLNTVHFFEDVSTGLVPLSELGRAVNVPTPLIDAVLDLISSLIDTDFRKEGRTLEKLGLSGLTAAGIRSAVE

SEQ ID NO: 151 - DNA, 1077 bp, Artificial Sequence
  Engineered variant of opine dehydrogenase CENDH
atgatcgagtcaaaaacatacgccgttttgggattaggaaacgggggtcacgcatttgccgcctatttagcattgaagggccagagtgtactggcttgggacatcgatgctcagagaatcaaagagattcaggaccgtggagccatcatagcggaaggaccaggacttgctgggactgctcacccggatcttctgacctcagatataggtttggcggttaaagacgctgatgtgatactgattgtagtgccggccatccaccacgcttccattgcagcaaatatcgccagttacatttccgagggtcagttgattatccttaaccctggggcaacgggtggagcgctggaattccggaaaatcctgcgtgaaaatggtgcgccggaggtaacgatcggggaaacctcaagtatgctctttacatgccgctccgagagaccaggacaggttacggtaaatgcgataacaggcgccatggactttgcatgtctcccagcggcaaaagctggatgggccctggaacagatagggtcggttcttcctcaatacgtggctgtcgaaaacgtgttgcatacttcgctgactaatatcgaagctgtattgcacccgctgccaacactgttaaacgctgctcgttgtgagtctggtaccccattccaatattatctggaggggattacgccatcagtcgggagtcttgcggagaaagtggacgctgaacgcatagcaatcgcaaaggctttcgatttaaacgttccgtcggtctgcgaatggcataagtctagttacggccagtcaccggccacaatttatgaagcggtgcagggtaatcctgctctgcgcggcattgcgggacctattaaccttaacacggtgcacttcttcgaggatgtaagcaccggactggtaccgttatccgaactgggtcgggcagtgaatgtgcctaccccacttatcgatgctgttcttgacttgatcagttcgctgatagacacggatttcagaaaggaaggtcgtaccttggaaaaattaggtctgagcggacttaccgccgcgggcataagaagtgctgttgag

SEQ ID NO: 152 - protein, 359 aa, Artificial Sequence
  Engineered variant of opine dehydrogenase CENDH
MIESKTYAVLGLGNGGHAFAAYLALKGQSVLAWDIDAQRIKEIQDRGAIIAEGPGLAGTAHPDLLTSDIGLAVKDADVILIVVPAIHHASIAANIASYISEGQLIILNPGATGGALEFRKILRENGAPEVTIGETSSMLFTCRSERPGQVTVNAITGAMDFACLPAAKAGWALEQIGSVLPQYVAVENVLHTSLTNIEAVLHPLPTLLNAARCESGTPFQYYLEGITPSVGSLAEKVDAERIAIAKAFDLNVPSVCEWHKSSYGQSPATIYEAVQGNPALRGIAGPINLNTVHFFEDVSTGLVPLSELGRAVNVPTPLIDAVLDLISSLIDTDFRKEGRTLEKLGLSGLTAAGIRSAVE

SEQ ID NO: 153 - DNA, 1077 bp, Artificial Sequence
  Engineered variant of opine dehydrogenase CENDH
atgatcgagtcaaaaacatacgccgttttgggattaggaaacgggggtcacgcatttgccgcctatttagcattgaagggccagagtgtactggcttgggacatcgatgctcagagaatcaaagagattcaggaccgtggagccatcatagcggaaggaccaggacttgctgggactgctcacccggatcttctgacctcagatataggtttggcggttaaagacgctgatgtgatactgattgtagtgccggccatccaccacgcttccattgcagcaaatatcgccagttacatttccgagggtcagttgattatccttaaccctggggcaacgggtggagcgctggaattccggaaaatcctgcgtgaaaatggtgcgccggaggtaacgatcggggaaacctcaagtatgctctttacatgccgctccgagagaccaggacaggttacggtaaatgcgataacaggcgccatggactttgcatgtctcccagcggcaaaagctggatgggccctggaacagatagggtcggttcttcctcaatacgtggctgtcgaaaacgtgttgcatacttcgctgactaatatcgaagctgtattgcacccgctgccaacactgttaaacgctgctcgttgtgagtctggtaccccattccaatattatctggaggggattacgccatcagtcgggagtcttgcggagaaagtggacgctgaacgcatagcaatcgcaaaggctttcgatttaaacgttccgtcggtctgcgaatggcataagattagttacggccagtcaccggccacaatttatgaagcggtgcagggtaatcctgctctgcgcggcattgcgggacctattaaccttaacacggtgcacttcttcgaggatgtaagcaccggactggtaccgttatccgaactgggtcgggcagtgaatgtgcctaccccacttatcgatgctgttcttgacttgatcagttcgctgatagacacggatttcagaaaggaaggtcgtaccttggaaaaattaggtctgagcggacttaccgccgcgggcataagaagtgctgttgag

SEQ ID NO: 154 - protein, 359 aa, Artificial Sequence
  Engineered variant of opine dehydrogenase CENDH
MIESKTYAVLGLGNGGHAFAAYLALKGQSVLAWDIDAQRIKEIQDRGAIIAEGPGLAGTAHPDLLTSDIGLAVKDADVILIVVPAIHHASIAANIASYISEGQLIILNPGATGGALEFRKILRENGAPEVTIGETSSMLFTCRSERPGQVTVNAITGAMDFACLPAAKAGWALEQIGSVLPQYVAVENVLHTSLTNIEAVLHPLPTLLNAARCESGTPFQYYLEGITPSVGSLAEKVDAERIAIAKAFDLNVPSVCEWHKISYGQSPATIYEAVQGNPALRGIAGPINLNTVHFFEDVSTGLVPLSELGRAVNVPTPLIDAVLDLISSLIDTDFRKEGRTLEKLGLSGLTAAGIRSAVE

SEQ ID NO: 155 - DNA, 1077 bp, Artificial Sequence
  Engineered variant of opine dehydrogenase CENDH
atgatcgagtcaaaaacatacgccgttttgggattaggaaacgggggtcacgcatttgccgcctatttagcattgaagggccagagtgtactggcttgggacatcgatgctcagagaatcaaagagattcaggaccgtggagccatcatagcggaaggaccaggacttgctgggactgctcacccggatcttctgacctcagatataggtttggcggttaaagacgctgatgtgatactgattgtagtgccggccatccaccacgcttccattgcagcaaatatcgccagttacatttccgagggtcagttgattatccttaaccctggggcaacgggtggagcgctggaattccggaaaatcctgcgtgaaaatggtgcgccggaggtaacgatcggggaaacctcaagtatgctctttacatgccgctccgagagaccaggacaggttacggtaaatgcgataacaggcaagatggactttgcatgtctcccagcggcaaaagctggatgggccctggaacagatagggtcggttcttcctcaatacgtggctgtcgaaaacgtgttgcatacttcgctgactaatatcgaagctgtattgcacccgctgccaacactgttaaacgctgctcgttgtgagtctggtaccccattccaatattatctggaggggattacgccatcagtcgggagtcttgcggagaaagtggacgctgaacgcatagcaatcgcaaaggctttcgatttaaacgttccgtcggtctgcgaatggcataaggaaagttacggccagtcaccggccacaatttatgaagcggtgcagggtaatcctgctctgcgcggcattgcgggacctattaaccttaacacggtgcacttcttcgaggatgtaagcaccggactggtaccgttatccgaactgggtcgggcagtgaatgtgcctaccccacttatcgatgctgttcttgacttgatcagttcgctgatagacacggatttcagaaaggaaggtcgtaccttggaaaaattaggtctgagcggacttaccgccgcgggcataagaagtgctgttgag

SEQ ID NO: 156 - protein, 359 aa, Artificial Sequence
  Engineered variant of opine dehydrogenase CENDH
MIESKTYAVLGLGNGGHAFAAYLALKGQSVLAWDIDAQRIKEIQDRGAIIAEGPGLAGTAHPDLLTSDIGLAVKDADVILIVVPAIHHASIAANIASYISEGQLIILNPGATGGALEFRKILRENGAPEVTIGETSSMLFTCRSERPGQVTVNAITGKMDFACLPAAKAGWALEQIGSVLPQYVAVENVLHTSLTNIEAVLHPLPTLLNAARCESGTPFQYYLEGITPSVGSLAEKVDAERIAIAKAFDLNVPSVCEWHKESYGQSPATIYEAVQGNPALRGIAGPINLNTVHFFEDVSTGLVPLSELGRAVNVPTPLIDAVLDLISSLIDTDFRKEGRTLEKLGLSGLTAAGIRSAVE

SEQ ID NO: 157 - DNA, 1077 bp, Artificial Sequence
  Engineered variant of opine dehydrogenase CENDH
atgatcgagtcaaaaacatacgccgttttgggattaggaaacgggggtcacgcatttgccgcctatttagcattgaagggccagagtgtactggcttgggacatcgatgctcagagaatcaaagagattcaggaccgtggagccatcatagcggaaggaccaggacttgctgggactgctcacccggatcttctgacctcagatataggtttggcggttaaagacgctgatgtgatactgattgtagtgccggccatccaccacgcttccattgcagcaaatatcgccagttacatttccgagggtcagttgattatccttaaccctggggcaacgggtggagcgctggaattccggaaaatcctgcgtgaaaatggtgcgccggaggtaacgatcggggaaacctcaagtatgctctttacatgccgctccgagagaccaggacaggttacggtaaatgcgataacaggcgccatggactttgcatgtctcccagcggcaaaagctggatgggccctggaacagatagggtcggttcttcctcaatacgtggctgtcgaaaacgtgttgcatacttcgctgactaatatcgaagctgtattgcacccgctgccaacactgttaaacgctgctcgttgtgagtctggtaccccattccaatattatctggaggggattacgccatcagtcgggagtcttgcggagaaagtggacgctgaacgcatagcaatcgcaaaggctttcgatttaaacgttccgtcggtctgcgaatggcataaggaaagttacggccagtcaccggccacaatttatgaagcggtgcagggtaatcctgctctgcgcggcattgcgggacctattaaccttaacacggtgcacttcttcgaggatgtaagcaccggactggtaccgttatccgaactgggtcgggcagtgaatgtgcctaccccacttatcgatgctgttcttctgttgatcagttcgctgatagacacggatttcagaaaggaaggtcgtaccttggaaaaattaggtctgagcggacttaccgccgcgggcataagaagtgctgttgag

SEQ ID NO: 158 - protein, 359 aa, Artificial Sequence
  Engineered variant of opine dehydrogenase CENDH
MIESKTYAVLGLGNGGHAFAAYLALKGQSVLAWDIDAQRIKEIQDRGAIIAEGPGLAGTAHPDLLTSDIGLAVKDADVILIVVPAIHHASIAANIASYISEGQLIILNPGATGGALEFRKILRENGAPEVTIGETSSMLFTCRSERPGQVTVNAITGAMDFACLPAAKAGWALEQIGSVLPQYVAVENVLHTSLTNIEAVLHPLPTLLNAARCESGTPFQYYLEGITPSVGSLAEKVDAERIAIAKAFDLNVPSVCEWHKESYGQSPATIYEAVQGNPALRGIAGPINLNTVHFFEDVSTGLVPLSELGRAVNVPTPLIDAVLLLISSLIDTDFRKEGRTLEKLGLSGLTAAGIRSAVE

SEQ ID NO: 159 - DNA, 1077 bp, Artificial Sequence
  Engineered variant of opine dehydrogenase CENDH
atgatcgagtcaaaaacatacgccgttttgggattaggaaacgggggtcacgcatttgccgcctatttagcattgaagggccagagtgtactggcttgggacatcgatgctcagagaatcaaagagattcaggaccgtggagccatcatagcggaaggaccaggacttgctgggactgctcacccggatcttctgacctcagatataggtttggcggttaaagacgctgatgtgatactgattgtagtgccggccatccaccacgcttccattgcagcaaatatcgccagttacatttccgagggtcagttgattatccttaaccctggggcaacgggtggagcgctggaattccggaaaatcctgcgtgaaaatggtgcgccggaggtaacgatcggggaaacctcaagtatgctctttacatgccgctccgagagaccaggacaggttacggtaaatgcgataacaggcgccatggactttgcatgtctcccagcggcaaaagctggatgggccctggaacagatagggtcggttcttcctcaatacgtggctgtcgaaaacgtgttgcatacttcgctgactaatatcgaagctgtattgcacccgctgccaacactgttaaacgctgctcgttgtgagtctggtaccccattccaatattatctggaggggattacgccatcagtcgggagtcttgcggagaaagtggacgctgaacgcatagcaatcgcaaaggctttcgatttaaacgttccgtcggtctgcgaatggcataagactagttacggccagtcaccggccacaatttatgaagcggtgcagggtaatcctgctctgcgcggcattgcgggacctattaaccttaacacggtgcacttcttcgaggatgtaagcaccggactggtaccgttatccgaactgggtcgggcagtgaatgtgcctaccccacttatcgatgctgttcttgacttgatcagttcgctgatagacacggatttcagaaaggaaggtcgtaccttggaaaaattaggtctgagcggacttaccgccgcgggcataagaagtgctgttgag

SEQ ID NO: 160 - protein, 359 aa, Artificial Sequence
  Engineered variant of opine dehydrogenase CENDH
MIESKTYAVLGLGNGGHAFAAYLALKGQSVLAWDIDAQRIKEIQDRGAIIAEGPGLAGTAHPDLLTSDIGLAVKDADVILIVVPAIHHASIAANIASYISEGQLIILNPGATGGALEFRKILRENGAPEVTIGETSSMLFTCRSERPGQVTVNAITGAMDFACLPAAKAGWALEQIGSVLPQYVAVENVLHTSLTNIEAVLHPLPTLLNAARCESGTPFQYYLEGITPSVGSLAEKVDAERIAIAKAFDLNVPSVCEWHKTSYGQSPATIYEAVQGNPALRGIAGPINLNTVHFFEDVSTGLVPLSELGRAVNVPTPLIDAVLDLISSLIDTDFRKEGRTLEKLGLSGLTAAGIRSAVE

SEQ ID NO: 161 - DNA, 1077 bp, Artificial Sequence
  Engineered variant of opine dehydrogenase CENDH
atgatcgagtcaaaaacatacgccgttttgggattaggaaacgggggtcacgcatttgccgcctatttagcattgaagggccagagtgtactggcttgggacatcgatgctcagagaatcaaagagattcaggaccgtggagccatcatagcggaaggaccaggacttgctgggactgctcacccggatcttctgacctcagatataggtttggcggttaaagacgctgatgtgatactgattgtagtgccggccatccaccacgcttccattgcagcaaatatcgccagttacatttccgagggtcagttgattatccttaaccctggggcaacgggtggagcgctggaattccggaaaatcctgcgtgaaaatggtgcgccggaggtaacgatcggggaaacctcaagtatgctctttacatgccgctccgagagaccaggacaggttacggtaaatgcgataacaggcgccatggactttgcatgtctcccagcggcaaaagctggatgggccctggaacagatagggtcggttcttcctcaatacgtggctgtcgaaaacgtgttgcatacttcgctgactaatatcgaagctgtattgcacccgctgccaacactgttaaacgctgctcgttgtgagtctggtaccccattccaatattatctggaggggattacgccatcagtcgggagtcttgcggagaaagtggacgctgaacgcatagcaatcgcaaaggctttcgatttaaacgttccgtcggtctgcgaatggcataagggtagttacggccagtcaccggccacaatttatgaagcggtgcagggtaatcctgctctgcgcggcattgcgggacctactaaccttaacacggtgcacttcttcgaggatgtaagcaccggactggtaccgttatccgaactgggtcgggcagtgaatgtgcctaccccacttatcgatgctgttcttgacttgatcagttcgctgatagacacggatttcagaaaggaaggtcgtaccttggaaaaattaggtctgagcggacttaccgccgcgggcataagaagtgctgttgag

SEQ ID NO: 162 - protein, 359 aa, Artificial Sequence
  Engineered variant of opine dehydrogenase CENDH
MIESKTYAVLGLGNGGHAFAAYLALKGQSVLAWDIDAQRIKEIQDRGAIIAEGPGLAGTAHPDLLTSDIGLAVKDADVILIVVPAIHHASIAANIASYISEGQLIILNPGATGGALEFRKILRENGAPEVTIGETSSMLFTCRSERPGQVTVNAITGAMDFACLPAAKAGWALEQIGSVLPQYVAVENVLHTSLTNIEAVLHPLPTLLNAARCESGTPFQYYLEGITPSVGSLAEKVDAERIAIAKAFDLNVPSVCEWHKGSYGQSPATIYEAVQGNPALRGIAGPTNLNTVHFFEDVSTGLVPLSELGRAVNVPTPLIDAVLDLISSLIDTDFRKEGRTLEKLGLSGLTAAGIRSAVE

SEQ ID NO: 163 - DNA, 1077 bp, Artificial Sequence
  Engineered variant of opine dehydrogenase CENDH
atgatcgagtcaaaaacatacgccgttttgggattaggaaacgggggtcacgcatttgccgcctatttagcattgaagggccagagtgtactggcttgggacatcgatgctcagagaatcaaagagattcaggaccgtggagccatcatagcggaaggaccaggacttgctgggactgctcacccggatcttctgacctcagatataggtttggcggttaaagacgctgatgtgatactgattgtagtgccggccatccaccacgcttccattgcagcaaatatcgccagttacatttccgagggtcagttgattatccttaaccctggggcaacgggtggagcgctggaattccggaaaatcctgcgtgaaaatggtgcgccggaggtaacgatcggggaaacctcaagtatgctctttacatgccgctccgagagaccaggactggttacggtaaatgcgataacaggcgccatggactttgcatgtctcccagcggcaaaagctggatgggccctggaacagatagggtcggttcttcctcaatacgtggctgtcgaaaacgtgttgcatacttcgctgactaatatcgaagctgtattgcacccgctgccaacactgttaaacgctgctcgttgtgagtctggtaccccattccaatattatctggaggggattacgccatcagtcgggagtcttgcggagaaagtggacgctgaacgcatagcaatcgcaaaggctttcgatttaaacgttccgtcggtctgcgaatggcataaggaaagttacggccagtcaccggccacaatttatgaagcggtgcagggtaatcctgctctgcgcggcattgcgggacctattaaccttaacacggtgcacttcttcgaggatgtaagcaccggactggtaccgttatccgaactgggtcgggcagtgaatgtgcctaccccacttatcgatgctgttcttgacttgatcagttcgctgatagacacggatttcagaaaggaaggtcgtaccttggaaaaattaggtctgagcggacttaccgccgcgggcataagaagtgctgttgag

SEQ ID NO: 164 - protein, 359 aa, Artificial Sequence
  Engineered variant of opine dehydrogenase CENDH
MIESKTYAVLGLGNGGHAFAAYLALKGQSVLAWDIDAQRIKEIQDRGAIIAEGPGLAGTAHPDLLTSDIGLAVKDADVILIVVPAIHHASIAANIASYISEGQLIILNPGATGGALEFRKILRENGAPEVTIGETSSMLFTCRSERPGLVTVNAITGAMDFACLPAAKAGWALEQIGSVLPQYVAVENVLHTSLTNIEAVLHPLPTLLNAARCESGTPFQYYLEGITPSVGSLAEKVDAERIAIAKAFDLNVPSVCEWHKESYGQSPATIYEAVQGNPALRGIAGPINLNTVHFFEDVSTGLVPLSELGRAVNVPTPLIDAVLDLISSLIDTDFRKEGRTLEKLGLSGLTAAGIRSAVE

SEQ ID NO: 165 - DNA, 1077 bp, Artificial Sequence
  Engineered variant of opine dehydrogenase CENDH
atgatcgagtcaaaaacatacgccgttttgggattaggaaacgggggtcacgcatttgccgcctatttagcattgaagggccagagtgtactggcttgggacatcgatgctcagagaatcaaagagattcaggaccgtggagccatcatagcggaaggaccaggacttgctgggactgctcacccggatcttctgacctcagatataggtttggcggttaaagacgctgatgtgatactgattgtagtgccggccatccaccacgcttccattgcagcaaatatcgccagttacatttccgagggtcagttgattatccttaaccctggggcaacgggtggagcgctggaattccggaaaatcctgcgtgaaaatggtgcgccggaggtaacgatcggggaaacctcaagtatgctctttacatgccgctccgagagaccaggacaggttacggtaaatgcgataacaggcgccatggactttgcatgtctcccagcggcaaaagctggatgggccctggaacagataggggaggttcttcctcaatacgtggctgtcgaaaacgtgttgcatacttcgctgactaatatcgaagctgtattgcacccgctgccaacactgttaaacgctgctcgttgtgagtctggtaccccattccaatattatctggaggggattacgccatcagtcgggagtcttgcggagaaagtggacgctgaacgcatagcaatcgcaaaggctttcgatttaaacgttccgtcggtctgcgaatggcataaggaaagttacggccagtcaccggccacaatttatgaagcggtgcagggtaatcctgctctgcgcggcattgcgggacctattaaccttaacacggtgcacttcttcgaggatgtaagcaccggactggtaccgttatccgaactgggtcgggcagtgaatgtgcctaccccacttatcgatgctgttcttgacttgatcagttcgctgatagacacggatttcagaaaggaaggtcgtaccttggaaaaattaggtctgagcggacttaccgccgcgggcataagaagtgctgttgag

SEQ ID NO: 166 - protein, 359 aa, Artificial Sequence
  Engineered variant of opine dehydrogenase CENDH
MIESKTYAVLGLGNGGHAFAAYLALKGQSVLAWDIDAQRIKEIQDRGAIIAEGPGLAGTAHPDLLTSDIGLAVKDADVILIVVPAIHHASIAANIASYISEGQLIILNPGATGGALEFRKILRENGAPEVTIGETSSMLFTCRSERPGQVTVNAITGAMDFACLPAAKAGWALEQIGEVLPQYVAVENVLHTSLTNIEAVLHPLPTLLNAARCESGTPFQYYLEGITPSVGSLAEKVDAERIAIAKAFDLNVPSVCEWHKESYGQSPATIYEAVQGNPALRGIAGPINLNTVHFFEDVSTGLVPLSELGRAVNVPTPLIDAVLDLISSLIDTDFRKEGRTLEKLGLSGLTAAGIRSAVE

SEQ ID NO: 167 - DNA, 1077 bp, Artificial Sequence
  Engineered variant of opine dehydrogenase CENDH
atgatcgagtcaaaaacatacgccgttttgggattaggaaacgggggtcacgcatttgccgcctatttagcattgaagggccagagtgtactggcttgggacatcgatgctcagagaatcaaagagattcaggaccgtggagccatcatagcggaaggaccaggacttgctgggactgctcacccggatcttctgacctcagatataggtttggcggttaaagacgctgatgtgatactgattgtagtgccggccatccaccacgcttccattgcagcaaatatcgccagttacatttccgagggtcagttgattatccttaaccctggggcaacgggtggagcgctggaattccggaaaatcctgcgtgaaaatggtgcgccggaggtaacgatcggggaaacctcaagtatgctctttacatgccgctccgagagaccaggacaggttacggtaaatgcgataacaggcgccatggactttgcatgtctcccagcggcaaaagctggatgggccctggaacagatagggtcggttcttcctcaatacgtggctgtcgaaaacgtgttgcatacttcgctgactaatatcgaagctgtattgcacccgctgccaacactgttaaacgctgctcgttgtgagtctggtaccccattccaatattatctggaggggattacgccatcagtcgggagtcttgcggagaaagtggacgctgaacgcatagcaatcgcaaaggctttcgatttaaacgttccgtcggtctgcgaatggcatggggaaagttacggccagtcaccggccacaatttatgaagcggtgcagggtaatcctgctctgcgcggcattgcgggacctattaaccttaacacggtgcacttcttcgaggatgtaagcaccggactggtaccgttatccgaactgggtcgggcagtgaatgtgcctaccccacttatcgatgctgttcttgacttgatcagttcgctgatagacacggatttcagaaaggaaggtcgtaccttggaaaaattaggtctgagcggacttaccgccgcgggcataagaagtgctgttgag

SEQ ID NO: 168 - protein, 359 aa, Artificial Sequence
  Engineered variant of opine dehydrogenase CENDH
MIESKTYAVLGLGNGGHAFAAYLALKGQSVLAWDIDAQRIKEIQDRGAIIAEGPGLAGTAHPDLLTSDIGLAVKDADVILIVVPAIHHASIAANIASYISEGQLIILNPGATGGALEFRKILRENGAPEVTIGETSSMLFTCRSERPGQVTVNAITGAMDFACLPAAKAGWALEQIGSVLPQYVAVENVLHTSLTNIEAVLHPLPTLLNAARCESGTPFQYYLEGITPSVGSLAEKVDAERIAIAKAFDLNVPSVCEWHGESYGQSPATIYEAVQGNPALRGIAGPINLNTVHFFEDVSTGLVPLSELGRAVNVPTPLIDAVLDLISSLIDTDFRKEGRTLEKLGLSGLTAAGIRSAVE

SEQ ID NO: 169 - DNA, 1077 bp, Artificial Sequence
  Engineered variant of opine dehydrogenase CENDH
atgatcgagtcaaaaacatacgccgttttgggattaggaaacgggggtcacgcatttgccgcctatttagcattgaagggccagagtgtactggcttgggacatcgatgctcagagaatcaaagagattcaggaccgtggagccatcatagcggaaggaccaggacttgctgggactgctcacccggatcttctgacctcagatataggtttggcggttaaagacgctgatgtgatactgattgtagtgccggccatccaccacgcttccattgcagcaaatatcgccagttacatttccgagggtcagttgattatccttaaccctggggcaacgggtggagcgctggaattccggaaaatcctgcgtgaaaatggtgcgccggaggtaacgatcggggaaacctcaagtatgctctttacatgccgctccgagagaccaggacaggttacggtaaatgcgataacaggcgccatggactttgcatgtctcccagcggcaaaagctggatgggccctggaacagatagggtcggttcttcctcaataccaggctgtcgaaaacgtgttgcatacttcgctgactaatatcgaagctgtattgcacccgctgccaacactgttaaacgctgctcgttgtgagtctggtaccccattccaatattatctggaggggattacgccatcagtcgggagtcttgcggagaaagtggacgctgaacgcatagcaatcgcaaaggctttcgatttaaacgttccgtcggtctgcgaatggcataaggaaagttacggccagtcaccggccacaatttatgaagcggtgcagggtaatcctgctctgcgcggcattgcgggacctattaaccttaacacggtgcacttcttcgaggatgtaagcaccggactggtaccgttatccgaactgggtcgggcagtgaatgtgcctaccccacttatcgatgctgttcttgacttgatcagttcgctgatagacacggatttcagaaaggaaggtcgtaccttggaaaaattaggtctgagcggacttaccgccgcgggcataagaagtgctgttgag

SEQ ID NO: 170 - protein, 359 aa, Artificial Sequence
  Engineered variant of opine dehydrogenase CENDH
MIESKTYAVLGLGNGGHAFAAYLALKGQSVLAWDIDAQRIKEIQDRGAIIAEGPGLAGTAHPDLLTSDIGLAVKDADVILIVVPAIHHASIAANIASYISEGQLIILNPGATGGALEFRKILRENGAPEVTIGETSSMLFTCRSERPGQVTVNAITGAMDFACLPAAKAGWALEQIGSVLPQYQAVENVLHTSLTNIEAVLHPLPTLLNAARCESGTPFQYYLEGITPSVGSLAEKVDAERIAIAKAFDLNVPSVCEWHKESYGQSPATIYEAVQGNPALRGIAGPINLNTVHFFEDVSTGLVPLSELGRAVNVPTPLIDAVLDLISSLIDTDFRKEGRTLEKLGLSGLTAAGIRSAVE

SEQ ID NO: 171 - DNA, 1077 bp, Artificial Sequence
  Engineered variant of opine dehydrogenase CENDH
atgatcgagtcaaaaacatacgccgttttgggattaggaaacgggggtcacgcatttgccgcctatttagcattgaagggccagagtgtactggcttgggacatcgatgctcagagaatcaaagagattcaggaccgtggagccatcatagcggaaggaccaggacttgctgggactgctcacccggatcttctgacctcagatataggtttggcggttaaagacgctgatgtgatactgattgtagtgccggccatccaccacgcttccattgcagcaaatatcgccagttacatttccgagggtcagttgattatccttaaccctggggcaacgggtggagcgctggaattccggaaaatcctgcgtgaaaatggtgcgccggaggtaacgatcggggaaacctcaagtatgctctttacatgccgctccgagagaccaggacaggttacggtaaatgcgataacaggcgccatggactttgcatgtctcccagcggcaaaagctggatgggccctggaacagatagggtcggttcttcctcaatacgtggctgtcgaaaacgtgttgcatacttcgctgactaatatcgaagctgtattgcacccgctgccaacactgttaaacgctgctcgttgtgagtctggtaccccattccaatattatctggaggggattacgccatcagtcgggagtcttgcggagaaagtggacgctgaacgcatagcaatcgcaaaggctttcgatttaaacgttccgtcggtctgcgaatggcataaggaaagttacggccagtcaccggccacaatttatgaagcggtgcagggtaatcctgctctgcgcggcattaagggacctattaaccttaacacggtgcacttcttcgaggatgtaagcaccggactggtaccgttatccgaactgggtcgggcagtgaatgtgcctaccccacttatcgatgctgttcttgacttgatcagttcgctgatagacacggatttcagaaaggaaggtcgtaccttggaaaaattaggtctgagcggacttaccgccgcgggcataagaagtgctgttgag

SEQ ID NO: 172 - protein, 359 aa, Artificial Sequence
  Engineered variant of opine dehydrogenase CENDH
MIESKTYAVLGLGNGGHAFAAYLALKGQSVLAWDIDAQRIKEIQDRGAIIAEGPGLAGTAHPDLLTSDIGLAVKDADVILIVVPAIHHASIAANIASYISEGQLIILNPGATGGALEFRKILRENGAPEVTIGETSSMLFTCRSERPGQVTVNAITGAMDFACLPAAKAGWALEQIGSVLPQYVAVENVLHTSLTNIEAVLHPLPTLLNAARCESGTPFQYYLEGITPSVGSLAEKVDAERIAIAKAFDLNVPSVCEWHKESYGQSPATIYEAVQGNPALRGIKGPINLNTVHFFEDVSTGLVPLSELGRAVNVPTPLIDAVLDLISSLIDTDFRKEGRTLEKLGLSGLTAAGIRSAVE

SEQ ID NO: 173 - DNA, 1077 bp, Artificial Sequence
  Engineered variant of opine dehydrogenase CENDH
atgatcgagtcaaaaacatacgccgttttgggattaggaaacgggggtcacgcatttgccgcctatttagcattgaagggccagagtgtactggcttgggacatcgatgctcagagaatcaaagagattcaggaccgtggagccatcatagcggaaggaccaggacttgctgggactgctcacccggatcttctgacctcagatataggtttggcggttaaagacgctgatgtgatactgattgtagtgccggccatccaccacgcttccattgcagcaaatatcgccagttacatttccgagggtcagttgattatccttaaccctggggcaacgggtggagcgctggaattccggaaaatcctgcgtgaaaatggtgcgccggaggtaacgatcggggaaacctcaagtatgctctttacatgccgctccgagagaccaggacaggttacggtaaatgcgataacagacgccatggactttgcatgtctcccagcggcaaaagctggatgggccctggaacagatagggtcggttcttcctcaatacgtggctgtcgaaaacgtgttgcatacttcgctgactaatatcgaagctgtattgcacccgctgccaacactgttaaacgctgctcgttgtgagtctggtaccccattccaatattatctggaggggattacgccatcagtcgggagtcttgcggagaaagtggacgctgaacgcatagcaatcgcatgggctttcgatttaaacgttccgtcggtctgcgaatggcataaggaaagttacggccagtcaccggccacaatttatgaagcggtgcagggtaatcctgctctgcgcggcattgcgggacctattaaccttaacacggtgcacttcttcgaggatgtaagcaccggactggtaccgttatccgaactgggtcgggcagtgaatgtgcctaccccacttatcgatgctgttcttgacttgatcagttcgctgatagacacggatttcagaaaggaaggtcgtaccttggaaaaattaggtctgagcggacttaccgccgcgggcataagaagtgctgttgag

SEQ ID NO: 174 - protein, 359 aa, Artificial Sequence
  Engineered variant of opine dehydrogenase CENDH
MIESKTYAVLGLGNGGHAFAAYLALKGQSVLAWDIDAQRIKEIQDRGAIIAEGPGLAGTAHPDLLTSDIGLAVKDADVILIVVPAIHHASIAANIASYISEGQLIILNPGATGGALEFRKILRENGAPEVTIGETSSMLFTCRSERPGQVTVNAITDAMDFACLPAAKAGWALEQIGSVLPQYVAVENVLHTSLTNIEAVLHPLPTLLNAARCESGTPFQYYLEGITPSVGSLAEKVDAERIAIAWAFDLNVPSVCEWHKESYGQSPATIYEAVQGNPALRGIAGPINLNTVHFFEDVSTGLVPLSELGRAVNVPTPLIDAVLDLISSLIDTDFRKEGRTLEKLGLSGLTAAGIRSAVE

SEQ ID NO: 175 - DNA, 1077 bp, Artificial Sequence
  Engineered variant of opine dehydrogenase CENDH
atgatcgagtcaaaaacatacgccgttttgggattaggaaacgggggtcacgcatttgccgcctatttagcattgaagggccagagggtactggcttgggacatcgatgctcagagaatcaaagagattcaggaccgtggagccatcatagcggaaggaccaggacttgctgggactgctcacccggatcttctgacctcagatataggtttggcggttaaagacgctgatgtgatactgattgtagtgccggccatccaccacgcttccattgcagcaaatatcgccagttacatttccgagggtcagttgattatccttaaccctggggcaacgggtggagcgctggaattccggaaaatcctgcgtgaaaatggtgcgccggaggtaacgatcggggaaacctcaagtatgctctttacatgccgctccgagagaccaggacaggttacggtaaatgcgataacaggcgccatggactttgcatgtctcccagcggcaaaagctggatgggccctggaacagatagggtcggttcttcctcaatacgtggctgtcgaaaacgtgttgcatacttcgctgactaatatcgaagctgtattgcacccgctgccaacactgttaaacgctgctcgttgtgagtctggtaccccattccaatattatctggaggggattacgccatcagtcgggagtcttgcggagaaagtggacgctgaacgcatagcaatcgcaaaggctttcgatttaaacgttccgtcggtctgcgaatggcataaggaaagttacggccagtcaccggccacaatttatgaagcggtgcagggtaatcctgctctgcgcggcattgcgggacctattaaccttaacacggtgcacttcttcgaggatgtaagcaccggactggtaccgttatccgaactgggtcgggcagtgaatgtgcctaccccacttatcgatgctgttcttgacttgatcagttcgctgatagacacggatttcagaaaggaaggtcgtaccttggaaaaattaggtctgagcggacttaccgccgcgggcataagaagtgctgttgag

SEQ ID NO: 176 - protein, 359 aa, Artificial Sequence
  Engineered variant of opine dehydrogenase CENDH
MIESKTYAVLGLGNGGHAFAAYLALKGQRVLAWDIDAQRIKEIQDRGAIIAEGPGLAGTAHPDLLTSDIGLAVKDADVILIVVPAIHHASIAANIASYISEGQLIILNPGATGGALEFRKILRENGAPEVTIGETSSMLFTCRSERPGQVTVNAITGAMDFACLPAAKAGWALEQIGSVLPQYVAVENVLHTSLTNIEAVLHPLPTLLNAARCESGTPFQYYLEGITPSVGSLAEKVDAERIAIAKAFDLNVPSVCEWHKESYGQSPATIYEAVQGNPALRGIAGPINLNTVHFFEDVSTGLVPLSELGRAVNVPTPLIDAVLDLISSLIDTDFRKEGRTLEKLGLSGLTAAGIRSAVE

SEQ ID NO: 177 - DNA, 1077 bp, Artificial Sequence
  Engineered variant of opine dehydrogenase CENDH
atgatcgagtcaaaaacatacgccgttttgggattaggaaacgggggtcacgcatttgccgcctatttagcattgaagggccagagtgtactggcttgggacatcgatgctcagagaatcaaagagattcaggaccgtggagccatcatagcggaaggaccaggacttgctgggactgctcacccggatcttctgacctcagatataggtttggcggttaaagacgctgatgtgatactgattgtagtgccggccatccaccacgcttccattgcagcaaatatcgccagttacatttgggagggtcagttgattatccttaaccctggggcaacgggtggagcgctggaattccggaaaatcctgcgtgaaaatggtgcgccggaggtaacgatcggggaaacctcaagtatgctctttacatgccgctccgagagaccaggacaggttacggtaaatgcgataacaggcgccatggactttgcatgtctcccagcggcaaaagctggatgggccctggaacagatagggtcggttcttcctcaatacgtggctgtcgaaaacgtgttgcatacttcgctgactaatatcgaagctgtattgcacccgctgccaacactgttaaacgctgctcgttgtgagtctggtaccccattccaatattatctggaggggattacgccatcagtcgggagtcttgcggagaaagtggacgctgaacgcatagcaatcgcaaaggctttcgatttaaacgttccgtcggtctgcgaatggcataaggaaagttacggccagtcaccggccacaatttatgaagcggtgcagggtaatcctgctctgcgcggcattgcgggacctattaaccttaacacggtgcacttcttcgaggatgtaagcaccggactggtaccgttatccgaactgggtcgggcagtgaatgtgcctaccccacttatcgatgctgttcttgacttgatcagttcgctgatagacacggatttcagaaaggaaggtcgtaccttggaaaaattaggtctgagcggacttaccgccgcgggcataagaagtgctgttgag

SEQ ID NO: 178 - protein, 359 aa, Artificial Sequence
  Engineered variant of opine dehydrogenase CENDH
MIESKTYAVLGLGNGGHAFAAYLALKGQSVLAWDIDAQRIKEIQDRGAIIAEGPGLAGTAHPDLLTSDIGLAVKDADVILIVVPAIHHASIAANIASYIWEGQLIILNPGATGGALEFRKILRENGAPEVTIGETSSMLFTCRSERPGQVTVNAITGAMDFACLPAAKAGWALEQIGSVLPQYVAVENVLHTSLTNIEAVLHPLPTLLNAARCESGTPFQYYLEGITPSVGSLAEKVDAERIAIAKAFDLNVPSVCEWHKESYGQSPATIYEAVQGNPALRGIAGPINLNTVHFFEDVSTGLVPLSELGRAVNVPTPLIDAVLDLISSLIDTDFRKEGRTLEKLGLSGLTAAGIRSAVE

SEQ ID NO: 179 - DNA, 1077 bp, Artificial Sequence
  Engineered variant of opine dehydrogenase CENDH
atgatcgagtcaaaaacatacgccgttttgggattaggaaacgggggtcacgcatttgccgcctatttagcattgaagggccagagtgtactggcttgggacatcgatgctcagagaatcaaagagattcaggaccgtggagccatcatagcggaaggaccaggacttgctgggactgctcacccggatcttctgacctcagatataggtttggcggttaaagacgctgatgtgatactgattgtagtgccggccatccaccacgcttccattgcagcaaatatcgccagttacatttccgagggtcagttgattatccttaaccctggggcaacgggtggagcgctggaattccggaaaatcctgcgtgaaaatggtgcgccggaggtaacgatcggggaaacctcaagtatgctctttacatgccgctccgagagaccaggacaggttacggtaaatgcgataacaggcgccatggactttgcatgtctcccagcggcaaaagctggatgggccctggaacagatagggtcggttcttcctcaatacgtggctgtcgaaaacgtgttgcatacttcgctgactaatatcgaagctgtattgcacccgctgccaacactgttaaacgctgctcgttgtgagtctggtaccccattccaatattatctggaggggattacgccatcagtcgggagtcttgcggagaaagtggacgctgaacgcatagcaatcgcaaaggctttcgatttaaacgttccgtcggtctgcgaatggcataaggaaagttacggccagtcaccggccacaatttatgaagcggtgcagggtaatcctgctctgcgcggcattgcgggacctattaaccttaacacggtgcacttcttcgaggatgtaagcaccggactggtaccgttatccgaactgggtcgggcagtgaatgtgcctaccccacttatcgatgctgttcttgacttgatcagttcgctgatagacacggatttcagaaaggaaggtcgtaccttggaaaaattaggtctgagcggacttaccgccgcgggcatcagacgggctgttgag

SEQ ID NO: 180 - protein, 359 aa, Artificial Sequence
  Engineered variant of opine dehydrogenase CENDH
MIESKTYAVLGLGNGGHAFAAYLALKGQSVLAWDIDAQRIKEIQDRGAIIAEGPGLAGTAHPDLLTSDIGLAVKDADVILIVVPAIHHASIAANIASYISEGQLIILNPGATGGALEFRKILRENGAPEVTIGETSSMLFTCRSERPGQVTVNAITGAMDFACLPAAKAGWALEQIGSVLPQYVAVENVLHTSLTNIEAVLHPLPTLLNAARCESGTPFQYYLEGITPSVGSLAEKVDAERIAIAKAFDLNVPSVCEWHKESYGQSPATIYEAVQGNPALRGIAGPINLNTVHFFEDVSTGLVPLSELGRAVNVPTPLIDAVLDLISSLIDTDFRKEGRTLEKLGLSGLTAAGIRRAVE

SEQ ID NO: 181 - DNA, 1077 bp, Artificial Sequence
  Engineered variant of opine dehydrogenase CENDH
atgatcgagtcaaaaacatacgccgttttgggattaggaaacgggggtcacgcatttgccgcctatttagcattgaagggccagagtgtactggcttgggacatcgatgctcagagaatcaaagagattcaggaccgtggagccatcatagcggaaggaccaggacttgctgggactgctcacccggatcttctgaccgatgatataggtttggcggttaaagacgctgatgtgatactgattgtagtgccggccatccaccacgcttccattgcagcaaatatcgccagttacatttccgagggtcagttgattatccttaaccctggggcaacgggtggagcgctggaattccggaaaatcctgcgtgaaaatggtgcgccggaggtaacgatcggggaaacctcaagtatgctctttacatgccgctccgagagaccaggacaggttacggtaaatgcgataacaggcgccatggactttgcatgtctcccagcggcaaaagctggatgggccctggaacagatagggtcggttcttcctcaatacgtggctgtcgaaaacgtgttgcatacttcgctgactaatatcgaagctgtattgcacccgctgccaacactgttaaacgctgctcgttgtgagtctggtaccccattccaatattatctggaggggattacgccatcagtcgggagtcttgcggagaaagtggacgctgaacgcatagcaatcgcaaaggctttcgatttaaacgttccgtcggtctgcgaatggcataaggaaagttacggccagtcaccggccacaatttatgaagcggtgcagggtaatcctgctctgcgcggcattgcgggacctattaaccttaacacggtgcacttcttcgaggatgtaagcaccggactggtaccgttatccgaactgggtcgggcagtgaatgtgcctaccccacttatcgatgctgttcttgacttgatcagttcgctgatagacacggatttcagaaaggaaggtcgtaccttggaaaaattaggtctgagcggacttaccgccgcgggcataagaagtgctgttgag

SEQ ID NO: 182 - protein, 359 aa, Artificial Sequence
  Engineered variant of opine dehydrogenase CENDH
MIESKTYAVLGLGNGGHAFAAYLALKGQSVLAWDIDAQRIKEIQDRGAIIAEGPGLAGTAHPDLLTDDIGLAVKDADVILIVVPAIHHASIAANIASYISEGQLIILNPGATGGALEFRKILRENGAPEVTIGETSSMLFTCRSERPGQVTVNAITGAMDFACLPAAKAGWALEQIGSVLPQYVAVENVLHTSLTNIEAVLHPLPTLLNAARCESGTPFQYYLEGITPSVGSLAEKVDAERIAIAKAFDLNVPSVCEWHKESYGQSPATIYEAVQGNPALRGIAGPINLNTVHFFEDVSTGLVPLSELGRAVNVPTPLIDAVLDLISSLIDTDFRKEGRTLEKLGLSGLTAAGIRSAVE

SEQ ID NO: 183 - DNA, 1077 bp, Artificial Sequence
  Engineered variant of opine dehydrogenase CENDH
atgatcgagtcaaaaacatacgccgttttgggattaggaaacgggggtcacgcatttgccgcctatttagcattgaagggccagagtgtactggcttgggacatcgatgctcagagaatcaaagagattcaggaccgtggagccatcatagcggaaggaccaggacttgctgggactgctcacccggatcttctgacctcagatataggtttggcggttaaagacgctgatgtgatactgattgtagtgccggccatccaccacgcttccattgcagcaaatatcgccagttacatttccgagggtcagttgattatccttaaccctggggcaacgggtggagcgctggaattccggaaaatcctgcgtgaaaatggtgcgccggaggtaacgatcggggaaacctcaagtatgctctttacatgccgctccgagagaccaggacaggttacggtaaatgcgataacaggcgccatggactttgcatgtctcccagcggcaaaagctggatgggccctggaacagatagggtcggttcttcctcaatacgtggctgtcgaaaacgtgttgcatacttcgctgactaatatcgaagctgtattgcacccgctgccaacactgttaaacgctgctcgttgtgagtctggtaccccattccaatattatctggaggggattacgccatcagtcgggcggcttgcggagaaagtggacgctgaacgcatagcaatcgcaaaggctttcgatttaaacgttccgtcggtctgcgaatggcataaggaaagttacggccagtcaccggccacaatttatgaagcggtgcagggtaatcctgctctgcgcggcattgcgggacctattaaccttaacacggtgcacttcttcgaggatgtaagcaccggactggtaccgttatccgaactgggtcgggcagtgaatgtgcctaccccacttatcgatgctgttcttgacttgatcagttcgctgatagacacggatttcagaaaggaaggtcgtaccttggaaaaattaggtctgagcggacttaccgccgcgggcataagaagtgctgttgag

SEQ ID NO: 184 - protein, 359 aa, Artificial Sequence
  Engineered variant of opine dehydrogenase CENDH
MIESKTYAVLGLGNGGHAFAAYLALKGQSVLAWDIDAQRIKEIQDRGAIIAEGPGLAGTAHPDLLTSDIGLAVKDADVILIVVPAIHHASIAANIASYISEGQLIILNPGATGGALEFRKILRENGAPEVTIGETSSMLFTCRSERPGQVTVNAITGAMDFACLPAAKAGWALEQIGSVLPQYVAVENVLHTSLTNIEAVLHPLPTLLNAARCESGTPFQYYLEGITPSVGRLAEKVDAERIAIAKAFDLNVPSVCEWHKESYGQSPATIYEAVQGNPALRGIAGPINLNTVHFFEDVSTGLVPLSELGRAVNVPTPLIDAVLDLISSLIDTDFRKEGRTLEKLGLSGLTAAGIRSAVE

SEQ ID NO: 185 - DNA, 1077 bp, Artificial Sequence
  Engineered variant of opine dehydrogenase CENDH
atgatcgagtcaaaaacatacgccgttttgggattaggaaacgggggtcacgcatttgccgcctatttagcattgaagggccagagtgtactggcttgggacatcgatgctcagagaatcaaagagattcaggaccgtggagccatcatagcggaaggaccaggacttgctgggactgctcacccggatcttctgacctcagatataggtttggcggttaaagacgctgatgtgatactgattgtagtgccggccatccaccacgcttccattgcagcaaatatcgccagttacatttccgagggtcagttgattatccttaaccctggggcaacgggtggagcgctggaattccggaaaatcctgcgtgaaaatggtgcgccggaggtaacgatcggggaaacctcaagtatgctctttacatgccgctccgagagaccaggacaggttacggtaaatgcgataacaggcgccatggactttgcatgtctcccagcggcaaaagctggatgggccctggaacagatagggtcggttcttcctcaatacgtggctgtcgaaaacgtgttgcatacttcgctgactaatatcgaagctgtattgcacccgctgccaacactgttaaacgctgctcgttgtgagtctggtaccccattccaatattatctggaggggattacgccatcagtcgggagtcttgcggagaaagtggacgctgaacgcatagcaatcgcaaaggctttcgatttaaacgttccgtcggtctgcgaatggcataaggaaagttacggccagtcaccggccacaatttatgaagcggtgcagggtaatcctgctctgcgcggcattgcgggaccttcgaaccttaacacggtgcacttcttcgaggatgtaagcaccggactggtaccgttatccgaactgggtcgggcagtgaatgtgcctaccccacttatcgatgctgttcttgacttgatcagttcgctgatagacacggatttcagaaaggaaggtcgtaccttggaaaaattaggtctgagcggacttaccgccgcgggcataagaagtgctgttgag

SEQ ID NO: 186 - protein, 359 aa, Artificial Sequence
  Engineered variant of opine dehydrogenase CENDH
MIESKTYAVLGLGNGGHAFAAYLALKGQSVLAWDIDAQRIKEIQDRGAIIAEGPGLAGTAHPDLLTSDIGLAVKDADVILIVVPAIHHASIAANIASYISEGQLIILNPGATGGALEFRKILRENGAPEVTIGETSSMLFTCRSERPGQVTVNAITGAMDFACLPAAKAGWALEQIGSVLPQYVAVENVLHTSLTNIEAVLHPLPTLLNAARCESGTPFQYYLEGITPSVGSLAEKVDAERIAIAKAFDLNVPSVCEWHKESYGQSPATIYEAVQGNPALRGIAGPSNLNTVHFFEDVSTGLVPLSELGRAVNVPTPLIDAVLDLISSLIDTDFRKEGRTLEKLGLSGLTAAGIRSAVE

SEQ ID NO: 187 - DNA, 1077 bp, Artificial Sequence
  Engineered variant of opine dehydrogenase CENDH
atgatcgagtcaaaaacatacgccgttttgggattaggaaacgggggtcacgcatttgccgcctatttagcattgaagggccagagtgtactggcttgggacatcgatgctcagagaatcaaagagattcaggaccgtggagccatcatagcggaaggaccaggacttgctgggactgctcacccggatcttctgacctcagatataggtttggcggttaaagacgctgatgtgatactgattgtagtgccggccatccaccacgcttccattgcagcaaatatcgccagttacatttccgagggtcagttgattatccttaaccctggggcaacgggtggagcgctggaattccggaaaatcctgcgtgaaaatggtgcgccggaggtaacgatcggggaaacctcaagtatgctctttacatgccgctccgagagaccaggacaggttacggtaaatgcgataacaggcgccatggactttgcatgtctcccagcggcaaaagctggatgggccctggaacagatagggtcggttcttcctcaatacgtggctgtcgaaaacgtgttgcatacttcgctgactaatatcgaagctgtattgcacccgctgccaacactgttaaacgctgctcgttgtgagtctggtaccccattccaatattatctggaggggattacgccatcagtcgggagtcttgcggagaaagtggacgctgaacgcatagcaatcgcaaaggctttcgatttaaacgttccgtcggtctgcgaatggcataaggaaagttacggccagtcaccggccacaatttatgaagcggtgcagggtaatcctgctctgcgcggcattgcgggacctattaaccttaacacggtgcacttcttcgaggatgtaagcaccggactggtaccgttatccgaactgggtcgggcagtgaatgtgcctaccccacttatcgatgctgttcttgacttgatcagttcgctgatagacgtggatttcagaaaggaaggtcgtaccttggaaaaattaggtctgagcggacttaccgccgcgggcataagaagtgctgttgag

SEQ ID NO: 188 - protein, 359 aa, Artificial Sequence
  Engineered variant of opine dehydrogenase CENDH
MIESKTYAVLGLGNGGHAFAAYLALKGQSVLAWDIDAQRIKEIQDRGAIIAEGPGLAGTAHPDLLTSDIGLAVKDADVILIVVPAIHHASIAANIASYISEGQLIILNPGATGGALEFRKILRENGAPEVTIGETSSMLFTCRSERPGQVTVNAITGAMDFACLPAAKAGWALEQIGSVLPQYVAVENVLHTSLTNIEAVLHPLPTLLNAARCESGTPFQYYLEGITPSVGSLAEKVDAERIAIAKAFDLNVPSVCEWHKESYGQSPATIYEAVQGNPALRGIAGPINLNTVHFFEDVSTGLVPLSELGRAVNVPTPLIDAVLDLISSLIDVDFRKEGRTLEKLGLSGLTAAGIRSAVE

SEQ ID NO: 189 - DNA, 1077 bp, Artificial Sequence
  Engineered variant of opine dehydrogenase CENDH
atgatcgagtcaaaaacatacgccgttttgggattaggaaacgggggtcacgcatttgccgcctatttagcattgaagggccagagtgtactggcttgggacatcgatgctcagagaatcaaagagattcaggaccgtggagccatcatagcggaaggaccaggacttgctgggactgctcacccggatcttctgacctcagatataggtttggcggttaaagacgctgatgtgatactgattgtagtgccggccatccaccacgcttccattgcagcaaatatcgccagttacatttccgagggtcagttgattatccttaaccctggggcaacgggtggagcgctggaattccggaaaatcctgcgtgaaaatggtgcgccggaggtaacgatcggggaaacctcaagtatgctctttacatgccgctccgagagaccaggacaggttacggtaaatgcgataacaggcgccatggactttgcatgtctcccagcggcaaaagctggatgggccctggaacagatagggtcggttcttcctcaatacgtggctaaggaaaacgtgttgcatacttcgctgactaatatcgaagctgtattgcacccgctgccaacactgttaaacgctgctcgttgtgagtctggtaccccattccaatattatctggaggggattacgccatcagtcgggagtcttgcggagaaagtggacgctgaacgcatagcaatcgcaaaggctttcgatttaaacgttccgtcggtctgcgaatggcataaggaaagttacggccagtcaccggccacaatttatgaagcggtgcagggtaatcctgctctgcgcggcattgcgggacctattaaccttaacacggtgcacttcttcgaggatgtaagcaccggactggtaccgttatccgaactgggtcgggcagtgaatgtgcctaccccacttatcgatgctgttcttgacttgatcagttcgctgatagacacggatttcagaaaggaaggtcgtaccttggaaaaattaggtctgagcggacttaccgccgcgggcataagaagtgctgttgag

SEQ ID NO: 190 - protein, 359 aa, Artificial Sequence
  Engineered variant of opine dehydrogenase CENDH
MIESKTYAVLGLGNGGHAFAAYLALKGQSVLAWDIDAQRIKEIQDRGAIIAEGPGLAGTAHPDLLTSDIGLAVKDADVILIVVPAIHHASIAANIASYISEGQLIILNPGATGGALEFRKILRENGAPEVTIGETSSMLFTCRSERPGQVTVNAITGAMDFACLPAAKAGWALEQIGSVLPQYVAKENVLHTSLTNIEAVLHPLPTLLNAARCESGTPFQYYLEGITPSVGSLAEKVDAERIAIAKAFDLNVPSVCEWHKESYGQSPATIYEAVQGNPALRGIAGPINLNTVHFFEDVSTGLVPLSELGRAVNVPTPLIDAVLDLISSLIDTDFRKEGRTLEKLGLSGLTAAGIRSAVE

SEQ ID NO: 191 - DNA, 1077 bp, Artificial Sequence
  Engineered variant of opine dehydrogenase CENDH
atgatcgagtcaaaaacatacgccgttttgggattaggaaacgggggtcacgcatttgccgcctatttagcattgaagggccagagtgtactggcttgggacatcgatgctcagagaatcaaagagattcaggaccgtggagccatcatagcggaaggaccaggacttgctgggactgctcacccggatcttctgacctcagatataggtttggcggttaaagacgctgatgtgatactgattgtagtgccggccatccaccacgcttccattgcagcaaatatcgccagttacatttccgagggtcagttgattatccttaaccctggggcaacgggtggagcgctggaattccggaaaatcctgcgtgaaaatggtgcgccggaggtaacgatcggggaaacctcaagtatgctctttacatgccgctccgagagaccaggacaggttacggtaaatgcgataacaggcgccatggactttgcatgtctcccagcggcaaaagctggatgggccctggaacagatagggtcggttcttcctcaatacgtggctgtcgaaaacgtgttgcatacttcgctgactaatatcgaagctgtattgcacccgctgccaacactgttaaacgctgctcgttgtgagtctggtaccccattccaatattatctggaggggattacgccatcagtcgggagtcttgcggagaaagtggacgctgaacgcatagcaatcgcaaaggctttcgatttaaacgttccgtcggtctgcgaatggcataagcgtagttacggccagtcaccggccacaatttatgaagcggtgcagggtaatcctgctctgcgcggcattgcgggacctattaaccttaacacggtgcacttcttcgaggatgtaagcaccggactggtaccgttatccgaactgggtcgggcagtgaatgtgcctaccccacttatcgatgctgttcttgacttgatcagttcgctgatagacacggatttcagaaaggaaggtcgtaccttggaaaaattaggtctgagcggacttaccgccgcgggcataagaagtgctgttgag

SEQ ID NO: 192 - protein, 359 aa, Artificial Sequence
  Engineered variant of opine dehydrogenase CENDH
MIESKTYAVLGLGNGGHAFAAYLALKGQSVLAWDIDAQRIKEIQDRGAIIAEGPGLAGTAHPDLLTSDIGLAVKDADVILIVVPAIHHASIAANIASYISEGQLIILNPGATGGALEFRKILRENGAPEVTIGETSSMLFTCRSERPGQVTVNAITGAMDFACLPAAKAGWALEQIGSVLPQYVAVENVLHTSLTNIEAVLHPLPTLLNAARCESGTPFQYYLEGITPSVGSLAEKVDAERIAIAKAFDLNVPSVCEWHKRSYGQSPATIYEAVQGNPALRGIAGPINLNTVHFFEDVSTGLVPLSELGRAVNVPTPLIDAVLDLISSLIDTDFRKEGRTLEKLGLSGLTAAGIRSAVE

SEQ ID NO: 193 - DNA, 1077 bp, Artificial Sequence
  Engineered variant of opine dehydrogenase CENDH
atgatcgagtcaaaaacatacgccgttttgggattaggaaacgggggtcacgcatttgccgcctatttagcattgaagggccagagtgtactggcttgggacatcgatgctcagagaatcaaagagattcaggaccgtggagccatcatagcggaaggaccaggacttgctgggactgctcacccggatcttctgacctcagatataggtttggcggttaaagacgctgatgtgatactgattgtagtgccggccatccaccacgcttccattgcagcaaatatcgccagttacatttccgagggtcagttgattatccttaaccctggggcaacgggtggagcgctggaattccggaaaatcctgcgtgaaaatggtgcgccggaggtaacgatcggggaaacctcaagtatgctctttacatgccgctccgagagaccaggacaggttacggtaaatgcgataacacgtgccatggactttgcatgtctcccagcggcaaaagctggatgggccctggaacagatagggtcggttcttcctcaatacgtggctgtcgaaaacgtgttgcatacttcgctgactaatatcgaagctgtattgcacccgctgccaacactgttaaacgctgctcgttgtgagtctggtaccccattccaatattatctggaggggattacgccatcagtcgggagtcttgcggagaaagtggacgctgaacgcatagcaatcgcaaaggctttcgatttaaacgttccgtcggtctgcgaatggcataaggaaagttacggccagtcaccggccacaatttatgaagcggtgcagggtaatcctgctctgcgcggcattgcgggacctattaaccttaacacggtgcacttcttcgaggatgtaagcaccggactggtaccgttatccgaactgggtcgggcagtgaatgtgcctaccccacttatcgatgctgttcttgacttgatcagttcgctgatagacacggatttcagaaaggaaggtcgtaccttggaaaaattaggtctgagcggacttaccgccgcgggcataagaagtgctgttgag

SEQ ID NO: 194 - protein, 359 aa, Artificial Sequence
  Engineered variant of opine dehydrogenase CENDH
MIESKTYAVLGLGNGGHAFAAYLALKGQSVLAWDIDAQRIKEIQDRGAIIAEGPGLAGTAHPDLLTSDIGLAVKDADVILIVVPAIHHASIAANIASYISEGQLIILNPGATGGALEFRKILRENGAPEVTIGETSSMLFTCRSERPGQVTVNAITRAMDFACLPAAKAGWALEQIGSVLPQYVAVENVLHTSLTNIEAVLHPLPTLLNAARCESGTPFQYYLEGITPSVGSLAEKVDAERIAIAKAFDLNVPSVCEWHKESYGQSPATIYEAVQGNPALRGIAGPINLNTVHFFEDVSTGLVPLSELGRAVNVPTPLIDAVLDLISSLIDTDFRKEGRTLEKLGLSGLTAAGIRSAVE

SEQ ID NO: 195 - DNA, 1077 bp, Artificial Sequence
  Engineered variant of opine dehydrogenase CENDH
atgatcgagtcaaaaacatacgccgttttgggattaggaaacgggggtcacgcatttgccgcctatttagcattgaagggccagagtgtactggcttgggacatcgatgctcagagaatcaaagagattcaggaccgtggagccatcatagcggaaggaccaggacttgctgggactgctcacccggatcttctgaccgctgatataggtttggcggttaaagacgctgatgtgatactgattgtagtgccggccatccaccacgcttccattgcagcaaatatcgccagttacatttccgagggtcagttgattatccttaaccctggggcaacgggtggagcgctggaattccggaaaatcctgcgtgaaaatggtgcgccggaggtaacgatcggggaaacctcaagtatgctctttacatgccgctccgagagaccaggacaggttacggtaaatgcgataacaggcgccatggactttgcatgtctcccagcggcaaaagctggatgggccctggaacagatagggtcggttcttcctcaatacgtggctgtcgaaaacgtgttgcatacttcgctgactaatatcgaagctgtattgcacccgctgccaacactgttaaacgctgctcgttgtgagtctggtaccccattccaatattatctggaggggattacgccatcagtcgggcggcttgcggagaaagtggacgctgaacgcatagcaatcgcaaaggctttcgatttaaacgttccgtcggtctgcgaatggcataaggaaagttacggccagtcaccggccacaatttatgaagcggtgcagggtaatcctgctctgcgcggcattgcgggacctattaaccttaacacggtgcacttcttcgaggatgtaagcaccggactggtaccgttatccgaactgggtcgggcagtgaatgtgcctaccccacttatcgatgctgttcttgacttgatcagttcgctgatagacacggatttcagaaaggaaggtcgtaccttggaaaaattaggtctgagcggacttaccgccgcgggcataagaagtgctgttgag

SEQ ID NO: 196 - protein, 359 aa, Artificial Sequence
  Engineered variant of opine dehydrogenase CENDH
MIESKTYAVLGLGNGGHAFAAYLALKGQSVLAWDIDAQRIKEIQDRGAIIAEGPGLAGTAHPDLLTADIGLAVKDADVILIVVPAIHHASIAANIASYISEGQLIILNPGATGGALEFRKILRENGAPEVTIGETSSMLFTCRSERPGQVTVNAITGAMDFACLPAAKAGWALEQIGSVLPQYVAVENVLHTSLTNIEAVLHPLPTLLNAARCESGTPFQYYLEGITPSVGRLAEKVDAERIAIAKAFDLNVPSVCEWHKESYGQSPATIYEAVQGNPALRGIAGPINLNTVHFFEDVSTGLVPLSELGRAVNVPTPLIDAVLDLISSLIDTDFRKEGRTLEKLGLSGLTAAGIRSAVE

SEQ ID NO: 197 - DNA, 1077 bp, Artificial Sequence
  Engineered variant of opine dehydrogenase CENDH
atgatcgagtcaaaaacatacgccgttttgggattaggaaacgggggtcacgcatttgccgcctatttagcattgaagggccagagtgtactggcttgggacatcgatgctcagagaatcaaagagattcaggaccgtggagccatcatagcggaaggaccaggacttgctgggactgctcacccggatcttctgacctcagatataggtttggcggttaaagacgctgatgtgatactgattgtagtgccggccatccaccacgcttccattgcagcaaatatcgccagttacatttccgagggtcagttgattatccttaaccctggggcaacgggtggagcgctggaattccggaaaatcctgcgtgaaaatggtgcgccggaggtaacgatcggggaaacctcaagtatgctctttacatgccgctccgagagaccaggacaggttacggtaaatgcgataacaggcgccatggactttgcatgtctcccagcggcaaaagctggatgggccctggaacagatagggtcggttcttcctcaatacgtggctgtcgaaaacgtgttgcatacttcgctgactaatatcgaagctgtattgcacccgctgccaacactgttaaacgctgctcgttgtgagtctggtaccccattccaatattatctggaggggattacgccatcagtcgggagtcttgcggagaaagtggacgctgaacgcatagcaatcgcaaaggctttcgatttaaacgttccgtcggtctgcgaatggcataaggaaagttacggccagtcaccggccacaatttatgaagcggtgcagggtaatcctgctctgcgcggcattgcgggacctattaaccttaacacggtgcacttcttcgaggatgtaagcaccggactggtaccgttatccgaactgggtcgggttgtgaatgtgcctaccccacttatcgatgctgttcttgacttgatcagttcgctgatagacacggatttcagaaaggaaggtcgtaccttggaaaaattaggtctgagcggacttaccgccgcgggcataagaagtgctgttgag

SEQ ID NO: 198 - protein, 359 aa, Artificial Sequence
  Engineered variant of opine dehydrogenase CENDH
MIESKTYAVLGLGNGGHAFAAYLALKGQSVLAWDIDAQRIKEIQDRGAIIAEGPGLAGTAHPDLLTSDIGLAVKDADVILIVVPAIHHASIAANIASYISEGQLIILNPGATGGALEFRKILRENGAPEVTIGETSSMLFTCRSERPGQVTVNAITGAMDFACLPAAKAGWALEQIGSVLPQYVAVENVLHTSLTNIEAVLHPLPTLLNAARCESGTPFQYYLEGITPSVGSLAEKVDAERIAIAKAFDLNVPSVCEWHKESYGQSPATIYEAVQGNPALRGIAGPINLNTVHFFEDVSTGLVPLSELGRVVNVPTPLIDAVLDLISSLIDTDFRKEGRTLEKLGLSGLTAAGIRSAVE

SEQ ID NO: 199 - DNA, 1077 bp, Artificial Sequence
  Engineered variant of opine dehydrogenase CENDH
atgatcgagtcaaaaacatacgccgttttgggattaggaaacgggggtcacgcatttgccgcctatttagcattgaagggccagagtgtactggcttgggacatcgatgctcagagaatcaaagagattcaggaccgtggagccatcatagcggaaggaccaggacttgctgggactgctcacccggatcttctgacctcagatataggtttggcggttaaagacgctgatgtgatactgattgtagtgccggccatccaccacgcttccattgcagcaaatatcgccagttacatttccgagggtcagttgattatccttaaccctggggcaacgggtggagcgctggaattccggaaaatcctgcgtgaaaatggtgcgccggaggtaacgatcggggaaacctcaagtatgctctttacatgccgctccgagagaccaggacaggttacggtaaatgcgataacaggcgccatggactttgcatgtctcccagcggcaaaagctggatgggccctggaacagatagggtcggttcttcctcaatacgtggctgtcgaaaacgtgttgcatacttcgctgactaatatcgaagctgtattgcacccgctgccaacactgttaaacgctgctcgttgtgagtctggtaccccattccaatattatctggaggggattacgccatcagtcgggagtcttgcggagaaagtggacgctgaacgcatagcaatcgcaaaggctttcgatttaaacgttccgtcggtctgcgaatggcataaggaaagttacggccagtcaccggccacaatttatgaagcggtgcagggtaatcctgctctgcgcggcattgcgggacctattaaccttaacacggtgcacttcttcgaggatgtaagcaccggactggtaccgttatccgaactgggtcgggcagtgaatgtgcctaccccacttatcgatgctgttcttgacttgatcagttcgctgatagacacggatttcagaaaggaaggtcgtaccttggaaaaattaggtctgagcggacttaccgccgcggagataagaagtgctgttgag

SEQ ID NO: 200 - protein, 359 aa, Artificial Sequence
  Engineered variant of opine dehydrogenase CENDH
MIESKTYAVLGLGNGGHAFAAYLALKGQSVLAWDIDAQRIKEIQDRGAIIAEGPGLAGTAHPDLLTSDIGLAVKDADVILIVVPAIHHASIAANIASYISEGQLIILNPGATGGALEFRKILRENGAPEVTIGETSSMLFTCRSERPGQVTVNAITGAMDFACLPAAKAGWALEQIGSVLPQYVAVENVLHTSLTNIEAVLHPLPTLLNAARCESGTPFQYYLEGITPSVGSLAEKVDAERIAIAKAFDLNVPSVCEWHKESYGQSPATIYEAVQGNPALRGIAGPINLNTVHFFEDVSTGLVPLSELGRAVNVPTPLIDAVLDLISSLIDTDFRKEGRTLEKLGLSGLTAAEIRSAVE

SEQ ID NO: 201 - DNA, 1077 bp, Artificial Sequence
  Engineered variant of opine dehydrogenase CENDH
atgatcgagtcaaaaacatacgccgttttgggattaggaaacgggggtcacgcatttgccgcctatttagcattgaagggccagagtgtactggcttgggacatcgatgctcagagaatcaaagagattcaggaccgtggagccatcatagcggaaggaccaggacttgctgggactgctcacccggatcttctgacctcagatataggtttggcggttaaagacgctgatgtgatactgattgtagtgccggccatccaccacgcttccattgcagcaaatatcgccagttacatttccgagggtcagttgattatccttaaccctggggcaacgggtggagcgctggaattccggaaaatcctgcgtgaaaatggtgcgccggaggtaacgatcggggaaacctcaagtatgctctttacatgccgctccgagagaccaggacaggttacggtaaatgcgataacaggcgccatggactttgcatgtctcccagcggcaaaagctggatgggccctggaacagatagggtcggttcttcctcaatacgtggctgtcgaaaacgtgttgcatacttcgctgactaatatcgaagctgtattgcacccgctgccaacactgttaaacgctgctcgttgtgagtctggtaccccattccaatattatctggaggggattacgccatcagtcgggagtcttgcggagaaagtggacgctgaacgcatagcaatcgcaaaggctttcgatttaaacgttccgtcggtctgcgaatggcataaggaaagttacggccagtcaccggccacaatttatgaagcggtgcagggtaatcctgctctgcgcggcattgcgggacctattaaccttaacacggtgcacttccgtgaggatgtaagcaccggactggtaccgttatccgaactgggtcgggcagtgaatgtgcctaccccacttatcgatgctgttcttgacttgatcagttcgctgatagacacggatttcagaaaggaaggtcgtaccttggaaaaattaggtctgagcggacttaccgccgcgggcataagaagtgctgttgag

SEQ ID NO: 202 - protein, 359 aa, Artificial Sequence
  Engineered variant of opine dehydrogenase CENDH
MIESKTYAVLGLGNGGHAFAAYLALKGQSVLAWDIDAQRIKEIQDRGAIIAEGPGLAGTAHPDLLTSDIGLAVKDADVILIVVPAIHHASIAANIASYISEGQLIILNPGATGGALEFRKILRENGAPEVTIGETSSMLFTCRSERPGQVTVNAITGAMDFACLPAAKAGWALEQIGSVLPQYVAVENVLHTSLTNIEAVLHPLPTLLNAARCESGTPFQYYLEGITPSVGSLAEKVDAERIAIAKAFDLNVPSVCEWHKESYGQSPATIYEAVQGNPALRGIAGPINLNTVHFREDVSTGLVPLSELGRAVNVPTPLIDAVLDLISSLIDTDFRKEGRTLEKLGLSGLTAAGIRSAVE

SEQ ID NO: 203 - DNA, 1077 bp, Artificial Sequence
  Engineered variant of opine dehydrogenase CENDH
atgatcgagtcaaaaacatacgccgttttgggattaggaaacgggggtcacgcatttgccgcctatttagcattgaagggccagcgtgtactggcttgggacatcgatgctcagagaatcaaagagattcaggaccgtggagccatcatagcggaaggaccaggacttgctgggactgctcacccggatcttctgacctcagatataggtttggcggttaaagacgctgatgtgatactgattgtagtgccggccatccaccacgcttccattgcagcaaatatcgccagttacatttccgagggtcagttgattatccttaaccctggggcaacgggtggagcgctggaattccggaaaatcctgcgtgaaaatggtgcgccggaggtaacgatcggggaaacctcaagtatgctctttacatgccgctccgagagaccaggacaggttacggtaaatgcgataacaggcgccatggactttgcatgtctcccagcggcaaaagctggatgggccctggaacagatagggtcggttcttcctcaataccgtgctgtcgaaaacgtgttgcatacttcgctgactaatatcgaagctgtattgcacccgctgccaacactgttaaacgctgctcgttgtgagtctggtaccccattccaatattataccgaggggattacgccatcagtcgggagtcttgcggagaaagtggacgctgaacgcatagcaatcgcaaaggctttcgatttaaacgttccgtcggtctgcgaatggcataaggcgagttacggccagtcaccggccacaatttatgaagcggtgcagggtaatcctgctctgcgcggcattgcgggacctaccagccttaacacggtgcacttcttcgaggatgtaagcaccggactggtaccgttatccgaactgggtcgggcagtgaatgtgcctaccccacttatcgatgctgttcttgacttgatcagttcgctgatagacacggatttcagaaaggaaggtcgtaccttggaaaaattaggtctgagcggacttaccgccgcgggcataagaagtgctgttgag

SEQ ID NO: 204 - protein, 359 aa, Artificial Sequence
  Engineered variant of opine dehydrogenase CENDH
MIESKTYAVLGLGNGGHAFAAYLALKGQRVLAWDIDAQRIKEIQDRGAIIAEGPGLAGTAHPDLLTSDIGLAVKDADVILIVVPAIHHASIAANIASYISEGQLIILNPGATGGALEFRKILRENGAPEVTIGETSSMLFTCRSERPGQVTVNAITGAMDFACLPAAKAGWALEQIGSVLPQYRAVENVLHTSLTNIEAVLHPLPTLLNAARCESGTPFQYYTEGITPSVGSLAEKVDAERIAIAKAFDLNVPSVCEWHKASYGQSPATIYEAVQGNPALRGIAGPTSLNTVHFFEDVSTGLVPLSELGRAVNVPTPLIDAVLDLISSLIDTDFRKEGRTLEKLGLSGLTAAGIRSAVE

SEQ ID NO: 205 - DNA, 1077 bp, Artificial Sequence
  Engineered variant of opine dehydrogenase CENDH
atgatcgagtcaaaaacatacgccgttttgggattaggaaacgggggtcacgcatttgccgcctatttagcattgaagggccagcgtgtactggcttgggacatcgatgctcagagaatcaaagagattcaggaccgtggagccatcatagcggaaggaccaggacttgctgggactgctcacccggatcttctgaccgatgatataggtttggcggttaaagacgctgatgtgatactgattgtagtgccggccatccaccacgcttccattgcagcaaatatcgccagttacatttccgagggtcagttgattatccttaaccctggggcaacgggtggagcgctggaattccggaaaatcctgcgtgaaaatggtgcgccggaggtaacgatcggggaaacctcaagtatgctctttacatgccgctccgagagaccaggacaggttacggtaaatgcgataacaggcgccatggactttgcatgtctcccagcggcaaaagctggatgggccctggaacagatagggtcggttcttcctcaatacgtggctcgtgaaaacgtgttgcatacttcgctgactaatatcgaagctgtattgcacccgctgccaacactgttaaacgctgctcgttgtgagtctggtaccccattccaatattataccgaggggattacgccatcagtcgggagtcttgcggagaaagtggacgctgaacgcatagcaatcgcaaaggctttcgatttaaacgttccgtcggtctgcgaatggcataagcgtagttacggccagtcaccggccacaatttatgaagcggtgcagggtaatcctgctctgcgcggcattgcgggacctattagccttaacacggtgcacttcttcgaggatgtaagcaccggactggtaccgttatccgaactgggtcgggcagtgaatgtgcctaccccacttatcgatgctgttcttgacttgatcagttcgctgatagacacggatttcagaaaggaaggtcgtaccttggaaaaattaggtctgagcggacttaccgccgcgggcataagaagtgctgttgag

SEQ ID NO: 206 - protein, 359 aa, Artificial Sequence
  Engineered variant of opine dehydrogenase CENDH
MIESKTYAVLGLGNGGHAFAAYLALKGQRVLAWDIDAQRIKEIQDRGAIIAEGPGLAGTAHPDLLTDDIGLAVKDADVILIVVPAIHHASIAANIASYISEGQLIILNPGATGGALEFRKILRENGAPEVTIGETSSMLFTCRSERPGQVTVNAITGAMDFACLPAAKAGWALEQIGSVLPQYVARENVLHTSLTNIEAVLHPLPTLLNAARCESGTPFQYYTEGITPSVGSLAEKVDAERIAIAKAFDLNVPSVCEWHKRSYGQSPATIYEAVQGNPALRGIAGPISLNTVHFFEDVSTGLVPLSELGRAVNVPTPLIDAVLDLISSLIDTDFRKEGRTLEKLGLSGLTAAGIRSAVE

SEQ ID NO: 207 - DNA, 1077 bp, Artificial Sequence
  Engineered variant of opine dehydrogenase CENDH
atgatcgagtcaaaaacatacgccgttttgggattaggaaacgggggtcacgcatttgccgcctatttagcattgaagggccagcgtgtactggcttgggacatcgatgctcagagaatcaaagagattcaggaccgtggagccatcatagcggaaggaccaggacttgctgggactgctcacccggatcttctgaccgatgatataggtttggcggttaaagacgctgatgtgatactgattgtagtgccggccatccaccacgcttccattgcagcaaatatcgccagttacatttccgagggtcagttgattatccttaaccctggggcaacgggtggagcgctggaattccggaaaatcctgcgtgaaaatggtgcgccggaggtaacgatcggggaaacctcaagtatgctctttacatgccgctccgagagaccaggacaggttacggtaaatgcgataacacgtgccatggactttgcatgtctcccagcggcaaaagctggatgggccctggaacagatagggtcggttcttcctcaatacgtggctcgtgaaaacgtgttgcatacttcgctgactaatatcgaagctgtattgcacccgctgccaacactgttaaacgctgctcgttgtgagtctggtaccccattcgattattataccgaggggattacgccatcagtcgggagtcttgcggagaaagtggacgctgaacgcatagcaatcgcaaaggctttcgatttaaacgttccgtcggtctgcgaatggcataaggcgagttacggccagtcaccggccacaatttatgaagcggtgcagggtaatcctgctctgcgcggcattgcgggacctattagccttaacacggtgcacttcttcgaggatgtaagcaccggactggtaccgttatccgaactgggtcgggcagtgaatgtgcctaccccacttatcgatgctgttcttgacttgatcagttcgctgatagacacggatttcagaaaggaaggtcgtaccttggaaaaattaggtctgagcggacttaccgccgcgggcataagaagtgctgttgag

SEQ ID NO: 208 - protein, 359 aa, Artificial Sequence
  Engineered variant of opine dehydrogenase CENDH
MIESKTYAVLGLGNGGHAFAAYLALKGQRVLAWDIDAQRIKEIQDRGAIIAEGPGLAGTAHPDLLTDDIGLAVKDADVILIVVPAIHHASIAANIASYISEGQLIILNPGATGGALEFRKILRENGAPEVTIGETSSMLFTCRSERPGQVTVNAITRAMDFACLPAAKAGWALEQIGSVLPQYVARENVLHTSLTNIEAVLHPLPTLLNAARCESGTPFDYYTEGITPSVGSLAEKVDAERIAIAKAFDLNVPSVCEWHKASYGQSPATIYEAVQGNPALRGIAGPISLNTVHFFEDVSTGLVPLSELGRAVNVPTPLIDAVLDLISSLIDTDFRKEGRTLEKLGLSGLTAAGIRSAVE

SEQ ID NO: 209 - DNA, 1077 bp, Artificial Sequence
  Engineered variant of opine dehydrogenase CENDH
atgatcgagtcaaaaacatacgccgttttgggattaggaaacgggggtcacgcatttgccgcctatttagcattgaagggccagagtgtactggcttgggacatcgatgctcagagaatcaaagagattcaggaccgtggagccatcatagcggaaggaccaggacttgctgggactgctcacccggatcttctgaccgatgatataggtttggcggttaaagacgctgatgtgatactgattgtagtgccggccatccaccacgcttccattgcagcaaatatcgccagttacatttccgagggtcagttgattatccttaaccctggggcaacgggtggagcgctggaattccggaaaatcctgcgtgaaaatggtgcgccggaggtaacgatcggggaaacctcaagtatgctctttacatgccgctccgagagaccaggacaggttacggtaaatgcgataacaggcgccatggactttgcatgtctcccagcggcaaaagctggatgggccctggaacagatagggtcggttcttcctcaataccgtgctgtcgaaaacgtgttgcatacttcgctgactaatatcgaagctgtattgcacccgctgccaacactgttaaacgctgctcgttgtgagtctggtaccccattccaatattataccgaggggattacgccatcagtcgggagtcttgcggagaaagtggacgctgaacgcatagcaatcgcaaaggctttcgatttaaacgttccgtcggtctgcgaatggcataagcgtagttacggccagtcaccggccacaatttatgaagcggtgcagggtaatcctgctctgcgcggcattgcgggacctaccggccttaacacggtgcacttcttcgaggatgtaagcaccggactggtaccgttatccgaactgggtcgggtggtgaatgtgcctaccccacttatcgatgctgttcttgacttgatcagttcgctgatagacacggatttcagaaaggaaggtcgtaccttggaaaaattaggtctgagcggacttaccgccgcgggcataagaagtgctgttgag

SEQ ID NO: 210 - protein, 359 aa, Artificial Sequence
  Engineered variant of opine dehydrogenase CENDH
MIESKTYAVLGLGNGGHAFAAYLALKGQSVLAWDIDAQRIKEIQDRGAIIAEGPGLAGTAHPDLLTDDIGLAVKDADVILIVVPAIHHASIAANIASYISEGQLIILNPGATGGALEFRKILRENGAPEVTIGETSSMLFTCRSERPGQVTVNAITGAMDFACLPAAKAGWALEQIGSVLPQYRAVENVLHTSLTNIEAVLHPLPTLLNAARCESGTPFQYYTEGITPSVGSLAEKVDAERIAIAKAFDLNVPSVCEWHKRSYGQSPATIYEAVQGNPALRGIAGPTGLNTVHFFEDVSTGLVPLSELGRVVNVPTPLIDAVLDLISSLIDTDFRKEGRTLEKLGLSGLTAAGIRSAVE

SEQ ID NO: 211 - DNA, 1077 bp, Artificial Sequence
  Engineered variant of opine dehydrogenase CENDH
atgatcgagtcaaaaacatacgccgttttgggattaggaaacgggggtcacgcatttgccgcctatttagcattgaagggccagcgtgtactggcttgggacatcgatgctcagagaatcaaagagattcaggaccgtggagccatcatagcggaaggaccaggacttgctgggactgctcacccggatcttctgaccgatgatataggtttggcggttaaagacgctgatgtgatactgattgtagtgccggccatccaccacgcttccattgcagcaaatatcgccagttacatttccgagggtcagttgattatccttaaccctggggcaacgggtggagcgctggaattccggaaaatcctgcgtgaaaatggtgcgccggaggtaacgatcggggaaacctcaagtatgctctttacatgccgctccgagagaccaggacaggttacggtaaatgcgataacacgtgccatggactttgcatgtctcccagcggcaaaagctggatgggccctggaacagatagggtcggttcttcctcaataccgtgctaaagaaaacgtgttgcatacttcgctgactaatatcgaagctgtattgcacccgctgccaacactgttaaacgctgctcgttgtgagtctggtaccccattccaatattatctggaggggattacgccatcagtcgggagtcttgcggagaaagtggacgctgaacgcatagcaatcgcaaaggctttcgatttaaacgttccgtcggtctgcgaatggcataaggaaagttacggccagtcaccggccacaatttatgaagcggtgcagggtaatcctgctctgcgcggcattatgggacctattagccttaacacggtgcacttcttcgaggatgtaagcaccggactggtaccgttatccgaactgggtcgggcagtgaatgtgcctaccccacttatcgatgctgttcttaccttgatcagttcgctgatagacacggatttcagaaaggaaggtcgtaccttggaaaaattaggtctgagcggacttaccgccgcgggcataagaagtgctgttgag

SEQ ID NO: 212 - protein, 359 aa, Artificial Sequence
  Engineered variant of opine dehydrogenase CENDH
MIESKTYAVLGLGNGGHAFAAYLALKGQRVLAWDIDAQRIKEIQDRGAIIAEGPGLAGTAHPDLLTDDIGLAVKDADVILIVVPAIHHASIAANIASYISEGQLIILNPGATGGALEFRKILRENGAPEVTIGETSSMLFTCRSERPGQVTVNAITRAMDFACLPAAKAGWALEQIGSVLPQYRAKENVLHTSLTNIEAVLHPLPTLLNAARCESGTPFQYYLEGITPSVGSLAEKVDAERIAIAKAFDLNVPSVCEWHKESYGQSPATIYEAVQGNPALRGIMGPISLNTVHFFEDVSTGLVPLSELGRAVNVPTPLIDAVLTLISSLIDTDFRKEGRTLEKLGLSGLTAAGIRSAVE

SEQ ID NO: 213 - DNA, 1077 bp, Artificial Sequence
  Engineered variant of opine dehydrogenase CENDH
atgatcgagtcaaaaacatacgccgttttgggattaggaaacgggggtcacgcatttgccgcctatttagcattgaagggccagcgtgtactggcttgggacatcgatgctcagagaatcaaagagattcaggaccgtggagccatcatagcggaaggaccaggacttgctgggactgctcacccggatcttctgacctcagatataggtttggcggttaaagacgctgatgtgatactgattgtagtgccggccatccaccacgcttccattgcagcaaatatcgccagttacatttccgagggtcagttgattatccttaaccctggggcaacgggtggagcgctggaattccggaaaatcctgcgtgaaaatggtgcgccggaggtaacgatcggggaaacctcaagtatgctctttacatgccgctccgagagaccaggacaggttacggtaaatgcgataacacgtgccatgaactttgcatgtctcccagcggcaaaagctggatgggccctggaacagatagggtcggttcttcctcaatacgtggctaaagaaaacgtgttgcatacttcgctgactaatatcgaagctgtattgcacccgctgccaacactgttaaacgctgctcgttgtgagtctggtaccccattcgattattataccgaggggattacgccatcagtcgggagtcttgcggagaaagtggacgctgaacgcatagcaatcgcaaaggctttcgatttaaacgttccgtcggtctgcgaatggcataaggaaagttacggccagtcaccggccacaatttatgaagcggtgcagggtaatcctgctctgcgcggcattatgggacctaccaaccttaacacggtgcacttcttcgaggatgtaagcaccggactggtaccgttatccgaactgggtcgggcagtgaatgtgcctaccccacttatcgatgctgttcttgacttgatcagttcgctgatagacacggatttcagaaaggaaggtcgtaccttggaaaaattaggtctgagcggacttaccgccgcgggcataagaagtgctgttgag

SEQ ID NO: 214 - protein, 359 aa, Artificial Sequence
  Engineered variant of opine dehydrogenase CENDH
MIESKTYAVLGLGNGGHAFAAYLALKGQRVLAWDIDAQRIKEIQDRGAIIAEGPGLAGTAHPDLLTSDIGLAVKDADVILIVVPAIHHASIAANIASYISEGQLIILNPGATGGALEFRKILRENGAPEVTIGETSSMLFTCRSERPGQVTVNAITRAMNFACLPAAKAGWALEQIGSVLPQYVAKENVLHTSLTNIEAVLHPLPTLLNAARCESGTPFDYYTEGITPSVGSLAEKVDAERIAIAKAFDLNVPSVCEWHKESYGQSPATIYEAVQGNPALRGIMGPTNLNTVHFFEDVSTGLVPLSELGRAVNVPTPLIDAVLDLISSLIDTDFRKEGRTLEKLGLSGLTAAGIRSAVE

SEQ ID NO: 215 - DNA, 1077 bp, Artificial Sequence
  Engineered variant of opine dehydrogenase CENDH
atgatcgagtcaaaaacatacgccgttttgggattaggaaacgggggtcacgcatttgccgcctatttagcattgaagggccagcgtgtactggcttgggacatcgatgctcagagaatcaaagagattcaggaccgtggagccatcatagcggaaggaccaggacttgctgggactgctcacccggatcttctgacctcagatataggtttggcggttaaagacgctgatgtgatactgattgtagtgccggccatccaccacgcttccattgcagcaaatatcgccagttacatttccgagggtcagttgattatccttaaccctggggcaacgggtggagcgctggaattccggaaaatcctgcgtgaaaatggtgcgccggaggtaacgatcggggaaacctcaagtatgctctttacatgccgctccgagagaccaggacaggttacggtaaatgcgataacacgtgccatggactttgcatgtctcccagcggcaaaagctggatgggccctggaacagatagggtcggttcttcctcaatacgtggctgtcgaaaacgtgttgcatacttcgctgactaatatcgaagctgtattgcacccgctgccaacactgttaaacgctgctcgttgtgagtctggtaccccattccaatattatctggaggggattacgccatcagtcgggagtcttgcggagaaagtggacgctgaacgcatagcaatcgcaaaggctttcgatttaaacgttccgtcggtctgcgaatggcataagaaaagttacggccagtcaccggccacaatttatgaagcggtgcagggtaatcctgctctgcgcggcattgcgggacctaccaaccttaacacggtgcacttcttcgaggatgtaagcaccggactggtaccgttatccgaactgggtcgggcagtgaatgtgcctaccccacttatcgatgctgttcttgacttgatcagttcgctgatagacacggatttcagaaaggaaggtcgtaccttggaaaaattaggtctgagcggacttaccgccgcgggcataagaagtgctgttgag

SEQ ID NO: 216 - protein, 359 aa, Artificial Sequence
  Engineered variant of opine dehydrogenase CENDH
MIESKTYAVLGLGNGGHAFAAYLALKGQRVLAWDIDAQRIKEIQDRGAIIAEGPGLAGTAHPDLLTSDIGLAVKDADVILIVVPAIHHASIAANIASYISEGQLIILNPGATGGALEFRKILRENGAPEVTIGETSSMLFTCRSERPGQVTVNAITRAMDFACLPAAKAGWALEQIGSVLPQYVAVENVLHTSLTNIEAVLHPLPTLLNAARCESGTPFQYYLEGITPSVGSLAEKVDAERIAIAKAFDLNVPSVCEWHKKSYGQSPATIYEAVQGNPALRGIAGPTNLNTVHFFEDVSTGLVPLSELGRAVNVPTPLIDAVLDLISSLIDTDFRKEGRTLEKLGLSGLTAAGIRSAVE

SEQ ID NO: 217 - DNA, 1077 bp, Artificial Sequence
  Engineered variant of opine dehydrogenase CENDH
atgatcgagtcaaaaacatacgccgttttgggattaggaaacgggggtcacgcatttgccgcctatttagcattgaagggccagagtgtactggcttgggacatcgatgctcagagaatcaaagagattcaggaccgtggagccatcatagcggaaggaccaggacttgctgggactgctcacccggatcttctgaccgatgatataggtttggcggttaaagacgctgatgtgatactgattgtagtgccggccatccaccacgcttccattgcagcaaatatcgccagttacatttccgagggtcagttgattatccttaaccctggggcaacgggtggagcgctggaattccggaaaatcctgcgtgaaaatggtgcgccggaggtaacgatcggggaaacctcaagtatgctctttacatgccgctccgagagaccaggacaggttacggtaaatgcgataacacgtgccatggactttgcatgtctcccagcggcaaaagctggatgggccctggaacagatagggtcggttcttcctcaatacgtggctaaagaaaacgtgttgcatacttcgctgactaatatcgaagctgtattgcacccgctgccaacactgttaaacgctgctcgttgtgagtctggtaccccattcgattattatctggaggggattacgccatcagtcgggagtcttgcggagaaagtggacgctgaacgcatagcaatcgcaaaggctttcgatttaaacgttccgtcggtctgcgaatggcataaggaaagttacggccagtcaccggccacaatttatgaagcggtgcagggtaatcctgctctgcgcggcattgcgggacctaccggccttaacacggtgcacttcttcgaggatgtaagcaccggactggtaccgttatccgaactgggtcgggtggtgaatgtgcctaccccacttatcgatgctgttcttgacttgatcagttcgctgatagacacggatttcagaaaggaaggtcgtaccttggaaaaattaggtctgagcggacttaccgccgcgggcataagaagtgctgttgag

SEQ ID NO: 218 - protein, 359 aa, Artificial Sequence
  Engineered variant of opine dehydrogenase CENDH
MIESKTYAVLGLGNGGHAFAAYLALKGQSVLAWDIDAQRIKEIQDRGAIIAEGPGLAGTAHPDLLTDDIGLAVKDADVILIVVPAIHHASIAANIASYISEGQLIILNPGATGGALEFRKILRENGAPEVTIGETSSMLFTCRSERPGQVTVNAITRAMDFACLPAAKAGWALEQIGSVLPQYVAKENVLHTSLTNIEAVLHPLPTLLNAARCESGTPFDYYLEGITPSVGSLAEKVDAERIAIAKAFDLNVPSVCEWHKESYGQSPATIYEAVQGNPALRGIAGPTGLNTVHFFEDVSTGLVPLSELGRVVNVPTPLIDAVLDLISSLIDTDFRKEGRTLEKLGLSGLTAAGIRSAVE

SEQ ID NO: 219 - DNA, 1077 bp, Artificial Sequence
  Engineered variant of opine dehydrogenase CENDH
atgatcgagtcaaaaacatacgccgttttgggattaggaaacgggggtcacgcatttgccgcctatttagcattgaagggccagcgtgtactggcttgggacatcgatgctcagagaatcaaagagattcaggaccgtggagccatcatagcggaaggaccaggacttgctgggactgctcacccggatcttctgacctcagatataggtttggcggttaaagacgctgatgtgatactgattgtagtgccggccatccaccacgcttccattgcagcaaatatcgccagttacatttccgagggtcagttgattatccttaaccctggggcaacgggtggagcgctggaattccggaaaatcctgcgtgaaaatggtgcgccggaggtaacgatcggggaaacctcaagtatgctctttacatgccgctccgagagaccaggacaggttacggtaaatgcgataacacgtgccatggactttgcatgtctcccagcggcaaaagctggatgggccctggaacagatagggtcggttcttcctcaataccgtgctgtcgaaaacgtgttgcatacttcgctgactaatatcgaagctgtattgcacccgctgccaacactgttaaacgctgctcgttgtgagtctggtaccccattcgattattatctggaggggattacgccatcagtcgggagtcttgcggagaaagtggacgctgaacgcatagcaatcgcaaaggctttcgatttaaacgttccgtcggtctgcgaatggcataagaaaagttacggccagtcaccggccacaatttatgaagcggtgcagggtaatcctgctctgcgcggcattgcgggacctattagccttaacacggtgcacttcttcgaggatgtaagcaccggactggtaccgttatccgaactgggtcgggtggtgaatgtgcctaccccacttatcgatgctgttcttgacttgatcagttcgctgatagacacggatttcagaaaggaaggtcgtaccttggaaaaattaggtctgagcggacttaccgccgcgggcataagaagtgctgttgag

SEQ ID NO: 220 - protein, 359 aa, Artificial Sequence
  Engineered variant of opine dehydrogenase CENDH
MIESKTYAVLGLGNGGHAFAAYLALKGQRVLAWDIDAQRIKEIQDRGAIIAEGPGLAGTAHPDLLTSDIGLAVKDADVILIVVPAIHHASIAANIASYISEGQLIILNPGATGGALEFRKILRENGAPEVTIGETSSMLFTCRSERPGQVTVNAITRAMDFACLPAAKAGWALEQIGSVLPQYRAVENVLHTSLTNIEAVLHPLPTLLNAARCESGTPFDYYLEGITPSVGSLAEKVDAERIAIAKAFDLNVPSVCEWHKKSYGQSPATIYEAVQGNPALRGIAGPISLNTVHFFEDVSTGLVPLSELGRVVNVPTPLIDAVLDLISSLIDTDFRKEGRTLEKLGLSGLTAAGIRSAVE

SEQ ID NO: 221 - DNA, 1077 bp, Artificial Sequence
  Engineered variant of opine dehydrogenase CENDH
atgatcgagtcaaaaacatacgccgttttgggattaggaaacgggggtcacgcatttgccgcctatttagcattgaagggccagagtgtactggcttgggacatcgatgctcagagaatcaaagagattcaggaccgtggagccatcatagcggaaggaccaggacttgctgggactgctcacccggatcttctgaccgatgatataggtttggcggttaaagacgctgatgtgatactgattgtagtgccggccatccaccacgcttccattgcagcaaatatcgccagttacatttccgagggtcagttgattatccttaaccctggggcaacgggtggagcgctggaattccggaaaatcctgcgtgaaaatggtgcgccggaggtaacgatcggggaaacctcaagtatgctctttacatgccgctccgagagaccaggacaggttacggtaaatgcgataacaggcgccatggactttgcatgtctcccagcggcaaaagctggatgggccctggaacagatagggtcggttcttcctcaataccgtgctaaagaaaacgtgttgcatacttcgctgactaatatcgaagctgtattgcacccgctgccaacactgttaaacgctgctcgttgtgagtctggtaccccattccaatattataccgaggggattacgccatcagtcgggagtcttgcggagaaagtggacgctgaacgcatagcaatcgcaaaggctttcgatttaaacgttccgtcggtctgcgaatggcataaggcgagttacggccagtcaccggccacaatttatgaagcggtgcagggtaatcctgctctgcgcggcattatgggacctattagccttaacacggtgcacttcttcgaggatgtaagcaccggactggtaccgttatccgaactgggtcgggcagtgaatgtgcctaccccacttatcgatgctgttcttgacttgatcagttcgctgatagacacggatttcagaaaggaaggtcgtaccttggaaaaattaggtctgagcggacttaccgccgcgggcataagaagtgctgttgag

SEQ ID NO: 222 - protein, 359 aa, Artificial Sequence
  Engineered variant of opine dehydrogenase CENDH
MIESKTYAVLGLGNGGHAFAAYLALKGQSVLAWDIDAQRIKEIQDRGAIIAEGPGLAGTAHPDLLTDDIGLAVKDADVILIVVPAIHHASIAANIASYISEGQLIILNPGATGGALEFRKILRENGAPEVTIGETSSMLFTCRSERPGQVTVNAITGAMDFACLPAAKAGWALEQIGSVLPQYRAKENVLHTSLTNIEAVLHPLPTLLNAARCESGTPFQYYTEGITPSVGSLAEKVDAERIAIAKAFDLNVPSVCEWHKASYGQSPATIYEAVQGNPALRGIMGPISLNTVHFFEDVSTGLVPLSELGRAVNVPTPLIDAVLDLISSLIDTDFRKEGRTLEKLGLSGLTAAGIRSAVE

SEQ ID NO: 223 - DNA, 1077 bp, Artificial Sequence
  Engineered variant of opine dehydrogenase CENDH
atgatcgagtcaaaaacatacgccgttttgggattaggaaacgggggtcacgcatttgccgcctatttagcattgaagggccagcgtgtactggcttgggacatcgatgctcagagaatcaaagagattcaggaccgtggagccatcatagcggaaggaccaggacttgctgggactgctcacccggatcttctgaccgatgatataggtttggcggttaaagacgctgatgtgatactgattgtagtgccggccatccaccacgcttccattgcagcaaatatcgccagttacatttccgagggtcagttgattatccttaaccctggggcaacgggtggagcgctggaattccggaaaatcctgcgtgaaaatggtgcgccggaggtaacgatcggggaaacctcaagtatgctctttacatgccgctccgagagaccaggacaggttacggtaaatgcgataacacgtgccatggactttgcatgtctcccagcggcaaaagctggatgggccctggaacagatagggtcggttcttcctcaatacgtggctcgtgaaaacgtgttgcatacttcgctgactaatatcgaagctgtattgcacccgctgccaacactgttaaacgctgctcgttgtgagtctggtaccccattccaatattataccgaggggattacgccatcagtcgggagtcttgcggagaaagtggacgctgaacgcatagcaatcgcaaaggctttcgatttaaacgttccgtcggtctgcgaatggcataaggaaagttacggccagtcaccggccacaatttatgaagcggtgcagggtaatcctgctctgcgcggcattatgggacctaccggccttaacacggtgcacttcttcgaggatgtaagcaccggactggtaccgttatccgaactgggtcgggcagtgaatgtgcctaccccacttatcgatgctgttcttgacttgatcagttcgctgatagacacggatttcagaaaggaaggtcgtaccttggaaaaattaggtctgagcggacttaccgccgcgggcataagaagtgctgttgag

SEQ ID NO: 224 - protein, 359 aa, Artificial Sequence
  Engineered variant of opine dehydrogenase CENDH
MIESKTYAVLGLGNGGHAFAAYLALKGQRVLAWDIDAQRIKEIQDRGAIIAEGPGLAGTAHPDLLTDDIGLAVKDADVILIVVPAIHHASIAANIASYISEGQLIILNPGATGGALEFRKILRENGAPEVTIGETSSMLFTCRSERPGQVTVNAITRAMDFACLPAAKAGWALEQIGSVLPQYVARENVLHTSLTNIEAVLHPLPTLLNAARCESGTPFQYYTEGITPSVGSLAEKVDAERIAIAKAFDLNVPSVCEWHKESYGQSPATIYEAVQGNPALRGIMGPTGLNTVHFFEDVSTGLVPLSELGRAVNVPTPLIDAVLDLISSLIDTDFRKEGRTLEKLGLSGLTAAGIRSAVE

SEQ ID NO: 225 - DNA, 1077 bp, Artificial Sequence
  Engineered variant of opine dehydrogenase CENDH
atgatcgagtcaaaaacatacgccgttttgggattaggaaacgggggtcacgcatttgccgcctatttagcattgaagggccagcgtgtactggcttgggacatcgatgctcagagaatcaaagagattcaggaccgtggagccatcatagcggaaggaccaggacttgctgggactgctcacccggatcttctgacctcagatataggtttggcggttaaagacgctgatgtgatactgattgtagtgccggccatccaccacgcttccattgcagcaaatatcgccagttacatttccgagggtcagttgattatccttaaccctggggcaacgggtggagcgctggaattccggaaaatcctgcgtgaaaatggtgcgccggaggtaacgatcggggaaacctcaagtatgctctttacatgccgctccgagagaccaggacaggttacggtaaatgcgataacaggcgccatggactttgcatgtctcccagcggcaaaagctggatgggccctggaacagatagggtcggttcttcctcaatacgtggctgtcgaaaacgtgttgcatacttcgctgactaatatcgaagctgtattgcacccgctgccaacactgttaaacgctgctcgttgtgagtctggtaccccattccaatattataccgaggggattacgccatcagtcgggagtcttgcggagaaagtggacgctgaacgcatagcaatcgcaaaggctttcgatttaaacgttccgtcggtctgcgaatggcataagaaaagttacggccaatcaccggccacaatttatgaagcggtgcagggtaatcctgctctgcgcggcattgcgggacctaccaaccttaacacggtgcacttcttcgaggatgtaagcaccggactggtaccgttatccgaactgggtcgggtggtgaatgtgcctaccccacttatcgatgctgttcttgacttgatcagttcgctgatagacacggatttcagaaaggaaggtcgtaccttggaaaaattaggtctgagcggacttaccgccgcgggcataagaagtgctgttgag

SEQ ID NO: 226 - protein, 359 aa, Artificial Sequence
  Engineered variant of opine dehydrogenase CENDH
MIESKTYAVLGLGNGGHAFAAYLALKGQRVLAWDIDAQRIKEIQDRGAIIAEGPGLAGTAHPDLLTSDIGLAVKDADVILIVVPAIHHASIAANIASYISEGQLIILNPGATGGALEFRKILRENGAPEVTIGETSSMLFTCRSERPGQVTVNAITGAMDFACLPAAKAGWALEQIGSVLPQYVAVENVLHTSLTNIEAVLHPLPTLLNAARCESGTPFQYYTEGITPSVGSLAEKVDAERIAIAKAFDLNVPSVCEWHKKSYGQSPATIYEAVQGNPALRGIAGPTNLNTVHFFEDVSTGLVPLSELGRVVNVPTPLIDAVLDLISSLIDTDFRKEGRTLEKLGLSGLTAAGIRSAVE

SEQ ID NO: 227 - DNA, 1077 bp, Artificial Sequence
  Engineered variant of opine dehydrogenase CENDH
atgatcgagtcaaaaacatacgccgttttgggattaggaaacgggggtcacgcatttgccgcctatttagcattgaagggccagcgtgtactggcttgggacatcgatgctcagagaatcaaagagattcaggaccgtggagccatcatagcggaaggaccaggacttgctgggactgctcacccggatcttctgaccgatgatataggtttggcggttaaagacgctgatgtgatactgattgtagtgccggccatccaccacgcttccattgcagcaaatatcgccagttacatttccgagggtcagttgattatccttaaccctggggcaacgggtggagcgctggaattccggaaaatcctgcgtgaaaatggtgcgccggaggtaacgatcggggaaacctcaagtatgctctttacatgccgctccgagagaccaggacaggttacggtaaatgcgataacaggcgccatgaactttgcatgtctcccagcggcaaaagctggatgggccctggaacagatagggtcggttcttcctcaatacgtggctaaagaaaacgtgttgcatacttcgctgactaatatcgaagctgtattgcacccgctgccaacactgttaaacgctgctcgttgtgagtctggtaccccattccaatattatctggaggggattacgccatcagtcgggagtcttgcggagaaagtggacgctgaacgcatagcaatcgcaaaggctttcgatttaaacgttccgtcggtctgcgaatggcataagcgtagttacggccagtcaccggccacaatttatgaagcggtgcagggtaatcctgctctgcgcggcattatgggacctattaaccttaacacggtgcacttcttcgaggatgtaagcaccggactggtaccgttatccgaactgggtcgggcagtgaatgtgcctaccccacttatcgatgctgttcttgacttgatcagttcgctgatagacacggatttcagaaaggaaggtcgtaccttggaaaaattaggtctgagcggacttaccgccgcgggcataagaagtgctgttgag

SEQ ID NO: 228 - protein, 359 aa, Artificial Sequence
  Engineered variant of opine dehydrogenase CENDH
MIESKTYAVLGLGNGGHAFAAYLALKGQRVLAWDIDAQRIKEIQDRGAIIAEGPGLAGTAHPDLLTDDIGLAVKDADVILIVVPAIHHASIAANIASYISEGQLIILNPGATGGALEFRKILRENGAPEVTIGETSSMLFTCRSERPGQVTVNAITGAMNFACLPAAKAGWALEQIGSVLPQYVAKENVLHTSLTNIEAVLHPLPTLLNAARCESGTPFQYYLEGITPSVGSLAEKVDAERIAIAKAFDLNVPSVCEWHKRSYGQSPATIYEAVQGNPALRGIMGPINLNTVHFFEDVSTGLVPLSELGRAVNVPTPLIDAVLDLISSLIDTDFRKEGRTLEKLGLSGLTAAGIRSAVE

SEQ ID NO: 229 - DNA, 1077 bp, Artificial Sequence
  Engineered variant of opine dehydrogenase CENDH
atgatcgagtcaaaaacatacgccgttttgggattaggaaacgggggtcacgcatttgccgcctatttagcattgaagggccagagtgtactggcttgggacatcgatgctcagagaatcaaagagattcaggaccgtggagccatcatagcggaaggaccaggacttgctgggactgctcacccggatcttctgaccgatgatataggtttggcggttaaagacgctgatgtgatactgattgtagtgccggccatccaccacgcttccattgcagcaaatatcgccagttacatttccgagggtcagttgattatccttaaccctggggcaacgggtggagcgctggaattccggaaaatcctgcgtgaaaatggtgcgccggaggtaacgatcggggaaacctcaagtatgctctttacatgccgctccgagagaccaggacaggttacggtaaatgcgataacacgtgccatggactttgcatgtctcccagcggcaaaagctggatgggccctggaacagatagggtcggttcttcctcaatacgtggttaaagaaaacgtgttgcatacttcgctgactaatatcgaagctgtattgcacccgctgccaacactgttaaacgctgctcgttgtgagtctggtaccccattcgattattatctggaggggattacgccatcagtcgggagtcttgcggagaaagtggacgctgaacgcatagcaatcgcaaaggctttcgatttaaacgttccgtcggtctgcgaatggcataagaaaagttacggccagtcaccggccacaatttatgaagcggtgcagggtaatcctgctctgcgcggcattgcgggacctaccagccttaacacggtgcacttcttcgaggatgtaagcaccggactggtaccgttatccgaactgggtcgggtggtgaatgtgcctaccccacttatcgatgctgttcttgacttgatcagttcgctgatagacacggatttcagaaaggaaggtcgtaccttggaaaaattaggtctgagcggacttaccgccgcgggcataagaagtgctgttgag

SEQ ID NO: 230 - protein, 359 aa, Artificial Sequence
  Engineered variant of opine dehydrogenase CENDH
MIESKTYAVLGLGNGGHAFAAYLALKGQSVLAWDIDAQRIKEIQDRGAIIAEGPGLAGTAHPDLLTDDIGLAVKDADVILIVVPAIHHASIAANIASYISEGQLIILNPGATGGALEFRKILRENGAPEVTIGETSSMLFTCRSERPGQVTVNAITRAMDFACLPAAKAGWALEQIGSVLPQYVVKENVLHTSLTNIEAVLHPLPTLLNAARCESGTPFDYYLEGITPSVGSLAEKVDAERIAIAKAFDLNVPSVCEWHKKSYGQSPATIYEAVQGNPALRGIAGPTSLNTVHFFEDVSTGLVPLSELGRVVNVPTPLIDAVLDLISSLIDTDFRKEGRTLEKLGLSGLTAAGIRSAVE

SEQ ID NO: 231 - DNA, 1077 bp, Artificial Sequence
  Engineered variant of opine dehydrogenase CENDH
atgatcgagtcaaaaacatacgccgttttgggattaggaaacgggggtcacgcatttgccgcctatttagcattgaagggccagcgtgtactggcttgggacatcgatgctcagagaatcaaagagattcaggaccgtggagccatcatagcggaaggaccaggacttgctgggactgctcacccggatcttctgaccgatgatataggtttggcggttaaagacgctgatgtgatactgattgtagtgccggccatccaccacgcttccattgcagcaaatatcgccagttacatttccgagggtcagttgattatccttaaccctggggcaacgggtggagcgctggaattccggaaaatcctgcgtgaaaatggtgcgccggaggtaacgatcggggaaacctcaagtatgctctttacatgccgctccgagagaccaggacaggttacggtaaatgcgataacacgtgccatggactttgcatgtctcccagcggcaaaagctggatgggccctggaacagatagggtcggttcttcctcaataccgtgctcgtgaaaacgtgttgcatacttcgctgactaatatcgaagctgtattgcacccgctgccaacactgttaaacgctgctcgttgtgagtctggtaccccattccaatattatctggaggggattacgccatcagtcgggagtcttgcggagaaagtggacgctgaacgcatagcaatcgcaaaggctttcgatttaaacgttccgtcggtctgcgaatggcataaggcgagttacggccagtcaccggccacaatttatgaagcggtgcagggtaatcctgctctgcgcggcattgcgggacctaccggccttaacacggtgcacttcttcgaggatgtaagcaccggactggtaccgttatccgaactgggtcgggcagtgaatgtgcctaccccacttatcgatgctgttcttgacttgatcagttcgctgatagacacggatttcagaaaggaaggtcgtaccttggaaaaattaggtctgagcggacttaccgccgcgggcataagaagtgctgttgag

SEQ ID NO: 232 - protein, 359 aa, Artificial Sequence
  Engineered variant of opine dehydrogenase CENDH
MIESKTYAVLGLGNGGHAFAAYLALKGQRVLAWDIDAQRIKEIQDRGAIIAEGPGLAGTAHPDLLTDDIGLAVKDADVILIVVPAIHHASIAANIASYISEGQLIILNPGATGGALEFRKILRENGAPEVTIGETSSMLFTCRSERPGQVTVNAITRAMDFACLPAAKAGWALEQIGSVLPQYRARENVLHTSLTNIEAVLHPLPTLLNAARCESGTPFQYYLEGITPSVGSLAEKVDAERIAIAKAFDLNVPSVCEWHKASYGQSPATIYEAVQGNPALRGIAGPTGLNTVHFFEDVSTGLVPLSELGRAVNVPTPLIDAVLDLISSLIDTDFRKEGRTLEKLGLSGLTAAGIRSAVE

SEQ ID NO: 233 - DNA, 1077 bp, Artificial Sequence
  Engineered variant of opine dehydrogenase CENDH
atgatcgagtcaaaaacatacgccgttttgggattaggaaacgggggtcacgcatttgccgcctatttagcattgaagggccagcgtgtactggcttgggacatcgatgctcagagaatcaaagagattcaggaccgtggagccatcatagcggaaggaccaggacttgctgggactgctcacccggatcttctgaccgatgatataggtttggcggttaaagacgctgatgtgatactgattgtagtgccggccatccaccacgcttccattgcagcaaatatcgccagttacatttccgagggtcagttgattatccttaaccctggggcaacgggtggagcgctggaattccggaaaatcctgcgtgaaaatggtgcgccggaggtaacgatcggggaaacctcaagtatgctctttacatgccgctccgagagaccaggacaggttacggtaaatgcgataacacgtgccatggactttgcatgtctcccagcggcaaaagctggatgggccctggaacagatagggtcggttcttcctcaatacgtggctgtcgaaaacgtgttgcatacttcgctgactaatatcgaagctgtattgcacccgctgccaacactgttaaacgctgctcgttgtgagtctggtaccccattccaatattataccgaggggattacgccatcagtcgggagtcttgcggagaaagtggacgctgaacgcatagcaatcgcaaaggctttcgatttaaacgttccgtcggtctgcgaatggcataagaaaagttacggccagtcaccggccacaatttatgaagcggtgcagggtaatcctgctctgcgcggcattgcgggacctattagccttaacacggtgcacttcttcgaggatgtaagcaccggactggtaccgttatccgaactgggtcgggtggtgaatgtgcctaccccacttatcgatgctgttcttaccttgatcagttcgctgatagacacggatttcagaaaggaaggtcgtaccttggaaaaattaggtctgagcggacttaccgccgcgggcataagaagtgctgttgag

SEQ ID NO: 234 - protein, 359 aa, Artificial Sequence
  Engineered variant of opine dehydrogenase CENDH
MIESKTYAVLGLGNGGHAFAAYLALKGQRVLAWDIDAQRIKEIQDRGAIIAEGPGLAGTAHPDLLTDDIGLAVKDADVILIVVPAIHHASIAANIASYISEGQLIILNPGATGGALEFRKILRENGAPEVTIGETSSMLFTCRSERPGQVTVNAITRAMDFACLPAAKAGWALEQIGSVLPQYVAVENVLHTSLTNIEAVLHPLPTLLNAARCESGTPFQYYTEGITPSVGSLAEKVDAERIAIAKAFDLNVPSVCEWHKKSYGQSPATIYEAVQGNPALRGIAGPISLNTVHFFEDVSTGLVPLSELGRVVNVPTPLIDAVLTLISSLIDTDFRKEGRTLEKLGLSGLTAAGIRSAVE

SEQ ID NO: 235 - DNA, 1077 bp, Artificial Sequence
  Engineered variant of opine dehydrogenase CENDH
atgatcgagtcaaaaacatacgccgttttgggattaggaaacgggggtcacgcatttgccgcctatttagcattgaagggccagcgtgtactggcttgggacatcgatgctcagagaatcaaagagattcaggaccgtggagccatcatagcggaaggaccaggacttgctgggactgctcacccggatcttctgaccgatgatataggtttggcggttaaagacgctgatgtgatactgattgtagtgccggccatccaccacgcttccattgcagcaaatatcgccagttacatttccgagggtcagttgattatccttaaccctggggcaacgggtggagcgctggaattccggaaaatcctgcgtgaaaatggtgcgccggaggtaacgatcggggaaacctcaagtatgctctttacatgccgctccgagagaccaggacaggttacggtaaatgcgataacacgtgccatggactttgcatgtctcccagcggcaaaagctggatgggccctggaacagatagggtcggttcttcctcaatacgtggctgtcgaaaacgtgttgcatacttcgctgactaatatcgaagctgtattgcacccgctgccaacactgttaaacgctgctcgttgtgagtctggtaccccattcgattattataccgaggggattacgccatcagtcgggagtcttgcggagaaagtggacgctgaacgcatagcaatcgcaaaggctttcgatttaaacgttccgtcggtctgcgaatggcataagaaaagttacggccagtcaccggccacaatttatgaagcggtgcagggtaatcctgctctgcgcggcattgcgggacctaccagccttaacacggtgcacttcttcgaggatgtaagcaccggactggtaccgttatccgaactgggtcgggtggtgaatgtgcctaccccacttatcgatgctgttcttaccttgatcagttcgctgatagacacggatttcagaaaggaaggtcgtaccttggaaaaattaggtctgagcggacttaccgccgcgggcataagaagtgctgttgag

SEQ ID NO: 236 - protein, 359 aa, Artificial Sequence
  Engineered variant of opine dehydrogenase CENDH
MIESKTYAVLGLGNGGHAFAAYLALKGQRVLAWDIDAQRIKEIQDRGAIIAEGPGLAGTAHPDLLTDDIGLAVKDADVILIVVPAIHHASIAANIASYISEGQLIILNPGATGGALEFRKILRENGAPEVTIGETSSMLFTCRSERPGQVTVNAITRAMDFACLPAAKAGWALEQIGSVLPQYVAVENVLHTSLTNIEAVLHPLPTLLNAARCESGTPFDYYTEGITPSVGSLAEKVDAERIAIAKAFDLNVPSVCEWHKKSYGQSPATIYEAVQGNPALRGIAGPTSLNTVHFFEDVSTGLVPLSELGRVVNVPTPLIDAVLTLISSLIDTDFRKEGRTLEKLGLSGLTAAGIRSAVE

SEQ ID NO: 237 - DNA, 1077 bp, Artificial Sequence
  Engineered variant of opine dehydrogenase CENDH
atgatcgagtcaaaaacatacgccgttttgggattaggaaacgggggtcacgcatttgccgcctatttagcattgaagggccagcgtgtactggcttgggacatcgatgctcagagaatcaaagagattcaggaccgtggagccatcatagcggaaggaccaggacttgctgggactgctcacccggatcttctgaccgatgatataggtttggcggttaaagacgctgatgtgatactgattgtagtgccggccatccaccacgcttccattgcagcaaatatcgccagttacatttccgagggtcagttgattatccttaaccctggggcaacgggtggagcgctggaattccggaaaatcctgcgtgaaaatggtgcgccggaggtaacgatcggggaaacctcaagtatgctctttacatgccgctccgagagaccaggacaggttacggtaaatgcgataacaggtgccatgaactttgcatgtctcccagcggcaaaagctggatgggccctggaacagatagggtcggttcttcctcaatacgtggctaaagaaaacgtgttgcatacttcgctgactaatatcgaagctgtattgcacccgctgccaacactgttaaacgctgctcgttgtgagtctggtaccccattcgattattatctggaggggattacgccatcagtcgggagtcttgcggagaaagtggacgctgaacgcatagcaatcgcaaaggctttcgatttaaacgttccgtcggtctgcgaatggcataaggcgagttacggccagtcaccggccacaatttatgaagcggtgcagggtaatcctgctctgcgcggcattgcgggacctaccagccttaacacggtgcacttcttcgaggatgtaagcaccggactggtaccgttatccgaactgggtcgggcagtgaatgtgcctaccccacttatcgatgctgttcttaccttgatcagttcgctgatagacacggatttcagaaaggaaggtcgtaccttggaaaaattaggtctgagcggacttaccgccgcgggcataagaagtgctgttgag

SEQ ID NO: 238 - protein, 359 aa, Artificial Sequence
  Engineered variant of opine dehydrogenase CENDH
MIESKTYAVLGLGNGGHAFAAYLALKGQRVLAWDIDAQRIKEIQDRGAIIAEGPGLAGTAHPDLLTDDIGLAVKDADVILIVVPAIHHASIAANIASYISEGQLIILNPGATGGALEFRKILRENGAPEVTIGETSSMLFTCRSERPGQVTVNAITGAMNFACLPAAKAGWALEQIGSVLPQYVAKENVLHTSLTNIEAVLHPLPTLLNAARCESGTPFDYYLEGITPSVGSLAEKVDAERIAIAKAFDLNVPSVCEWHKASYGQSPATIYEAVQGNPALRGIAGPTSLNTVHFFEDVSTGLVPLSELGRAVNVPTPLIDAVLTLISSLIDTDFRKEGRTLEKLGLSGLTAAGIRSAVE

SEQ ID NO: 239 - DNA, 1077 bp, Artificial Sequence
  Engineered variant of opine dehydrogenase CENDH
atgatcgagtcaaaaacatacgccgttttgggattaggaaacgggggtcacgcatttgccgcctatttagcattgaagggccagcgtgtactggcttgggacatcgatgctcagagaatcaaagagattcaggaccgtggagccatcatagcggaaggaccaggacttgctgggactgctcacccggatcttctgaccgatgatataggtttggcggttaaagacgctgatgtgatactgattgtagtgccggccatccaccacgcttccattgcagcaaatatcgccagttacatttccgagggtcagttgattatccttaaccctggggcaacgggtggagcgctggaattccggaaaatcctgcgtgaaaatggtgcgccggaggtaacgatcggggaaacctcaagtatgctctttacatgccgctccgagagaccaggacaggttacggtaaatgcgataacacgtgccatggactttgcatgtctcccagcggcaaaagctggatgggccctggaacagatagggtcggttcttcctcaatacgtggctgtcgaaaacgtgttgcatacttcgctgactaatatcgaagctgtattgcacccgctgccaacactgttaaacgctgctcgttgtgagtctggtaccccattccaatattatctggaggggattacgccatcagtcgggagtcttgcggagaaagtggacgctgaacgcatagcaatcgcaaaggctttcgatttaaacgttccgtcggtctgcgaatggcataagcgtagttacggccagtcaccggccacaatttatgaagcggtgcagggtaatcctgctctgcgcggcattgcgggacctaccagccttaacacggtgcacttcttcgaggatgtaagcaccggactggtaccgttatccgaactgggtcgggcagtgaatgtgcctaccccacttatcgatgctgttcttgacttgatcagttcgctgatagacacggatttcagaaaggaaggtcgtaccttggaaaaattaggtctgagcggacttaccgccgcgggcataagaagtgctgttgag

SEQ ID NO: 240 - protein, 359 aa, Artificial Sequence
  Engineered variant of opine dehydrogenase CENDH
MIESKTYAVLGLGNGGHAFAAYLALKGQRVLAWDIDAQRIKEIQDRGAIIAEGPGLAGTAHPDLLTDDIGLAVKDADVILIVVPAIHHASIAANIASYISEGQLIILNPGATGGALEFRKILRENGAPEVTIGETSSMLFTCRSERPGQVTVNAITRAMDFACLPAAKAGWALEQIGSVLPQYVAVENVLHTSLTNIEAVLHPLPTLLNAARCESGTPFQYYLEGITPSVGSLAEKVDAERIAIAKAFDLNVPSVCEWHKRSYGQSPATIYEAVQGNPALRGIAGPTSLNTVHFFEDVSTGLVPLSELGRAVNVPTPLIDAVLDLISSLIDTDFRKEGRTLEKLGLSGLTAAGIRSAVE

SEQ ID NO: 241 - DNA, 1077 bp, Artificial Sequence
  Engineered variant of opine dehydrogenase CENDH
atgatcgagtcaaaaacatacgccgttttgggattaggaaacgggggtcacgcatttgccgcctatttagcattgaagggccagagtgtactggcttgggacatcgatgctcagagaatcaaagagattcaggaccgtggagccatcatagcggaaggaccaggacttgctgggactgctcacccggatcttctgaccgatgatataggtttggcggttaaagacgctgatgtgatactgattgtagtgccggccatccaccacgcttccattgcagcaaatatcgccagttacatttccgagggtcagttgattatccttaaccctggggcaacgggtggagcgctggaattccggaaaatcctgcgtgaaaatggtgcgccggaggtaacgatcggggaaacctcaagtatgctctttacatgccgctccgagagaccaggacaggttacggtaaatgcgataacaggcgccatgaactttgcatgtctcccagcggcaaaagctggatgggccctggaacagatagggtcggttcttcctcaatacgtggctaaagaaaacgtgttgcatacttcgctgactaatatcgaagctgtattgcacccgctgccaacactgttaaacgctgctcgttgtgagtctggtaccccattccaatattatctggaggggattacgccatcagtcgggagtcttgcggagaaagtggacgctgaacgcatagcaatcgcaaaggctttcgatttaaacgttccgtcggtctgcgaatggcataaggcgagttacggccagtcaccggccacaatttatgaagcggtgcagggtaatcctgctctgcgcggcattatgggacctattagccttaacacggtgcacttcttcgaggatgtaagcaccggactggtaccgttatccgaactgggtcgggtggtgaatgtgcctaccccacttatcgatgctgttcttaccttgatcagttcgctgatagacacggatttcagaaaggaaggtcgtaccttggaaaaattaggtctgagcggacttaccgccgcgggcataagaagtgctgttgag

SEQ ID NO: 242 - protein, 359 aa, Artificial Sequence
  Engineered variant of opine dehydrogenase CENDH
MIESKTYAVLGLGNGGHAFAAYLALKGQSVLAWDIDAQRIKEIQDRGAIIAEGPGLAGTAHPDLLTDDIGLAVKDADVILIVVPAIHHASIAANIASYISEGQLIILNPGATGGALEFRKILRENGAPEVTIGETSSMLFTCRSERPGQVTVNAITGAMNFACLPAAKAGWALEQIGSVLPQYVAKENVLHTSLTNIEAVLHPLPTLLNAARCESGTPFQYYLEGITPSVGSLAEKVDAERIAIAKAFDLNVPSVCEWHKASYGQSPATIYEAVQGNPALRGIMGPISLNTVHFFEDVSTGLVPLSELGRVVNVPTPLIDAVLTLISSLIDTDFRKEGRTLEKLGLSGLTAAGIRSAVE

SEQ ID NO: 243 - DNA, 1077 bp, Artificial Sequence
  Engineered variant of opine dehydrogenase CENDH
atgatcgagtcaaaaacatacgccgttttgggattaggaaacgggggtcacgcatttgccgcctatttagcattgaagggccagcgtgtactggcttgggacatcgatgctcagagaatcaaagagattcaggaccgtggagccatcatagcggaaggaccaggacttgctgggactgctcacccggatcttctgacctcagatataggtttggcggttaaagacgctgatgtgatactgattgtagtgccggccatccaccacgcttccattgcagcaaatatcgccagttacatttccgagggtcagttgattatccttaaccctggggcaacgggtggagcgctggaattccggaaaatcctgcgtgaaaatggtgcgccggaggtaacgatcggggaaacctcaagtatgctctttacatgccgctccgagagaccaggacaggttacggtaaatgcgataacaggcgccatggactttgcatgtctcccagcggcaaaagctggatgggccctggaacagatagggtcggttcttcctcaatacgtggctaaagaaaacgtgttgcatacttcgctgactaatatcgaagctgtattgcacccgctgccaacactgttaaacgctgctcgttgtgagtctggtaccccattcgattattataccgaggggattacgccatcagtcgggagtcttgcggagaaagtggacgctgaacgcatagcaatcgcaaaggctttcgatttaaacgttccgtcggtctgcgaatggcataagagcagttacggccagtcaccggccacaatttatgaagcggtgcagggtaatcctgctctgcgcggcattgcgggacctaccggccttaacacggtgcacttcttcgaggatgtaagcaccggactggtaccgttatccgaactgggtcgggtggtgaatgtgcctaccccacttatcgatgctgttcttaccttgatcagttcgctgatagacacggatttcagaaaggaaggtcgtaccttggaaaaattaggtctgagcggacttaccgccgcgggcataagaagtgctgttgag

SEQ ID NO: 244 - protein, 359 aa, Artificial Sequence
  Engineered variant of opine dehydrogenase CENDH
MIESKTYAVLGLGNGGHAFAAYLALKGQRVLAWDIDAQRIKEIQDRGAIIAEGPGLAGTAHPDLLTSDIGLAVKDADVILIVVPAIHHASIAANIASYISEGQLIILNPGATGGALEFRKILRENGAPEVTIGETSSMLFTCRSERPGQVTVNAITGAMDFACLPAAKAGWALEQIGSVLPQYVAKENVLHTSLTNIEAVLHPLPTLLNAARCESGTPFDYYTEGITPSVGSLAEKVDAERIAIAKAFDLNVPSVCEWHKSSYGQSPATIYEAVQGNPALRGIAGPTGLNTVHFFEDVSTGLVPLSELGRVVNVPTPLIDAVLTLISSLIDTDFRKEGRTLEKLGLSGLTAAGIRSAVE

SEQ ID NO: 245 - DNA, 1077 bp, Artificial Sequence
  Engineered variant of opine dehydrogenase CENDH
atgatcgagtcaaaaacatacgccgttttgggattaggaaacgggggtcacgcatttgccgcctatttagcattgaagggccagcgtgtactggcttgggacatcgatgctcagagaatcaaagagattcaggaccgtggagccatcatagcggaaggaccaggacttgctgggactgctcacccggatcttctgaccgatgatataggtttggcggttaaagacgctgatgtgatactgattgtagtgccggccatccaccacgcttccattgcagcaaatatcgccagttacatttccgagggtcagttgattatccttaaccctggggcaacgggtggagcgctggaattccggaaaatcctgcgtgaaaatggtgcgccggaggtaacgatcggggaaacctcaagtatgctctttacatgccgctccgagagaccaggacaggttacggtaaatgcgataacaggcgccatggactttgcatgtctcccagcggcaaaagctggatgggccctggaacagatagggtcggttcttcctcaataccgtgctgtcgaaaacgtgttgcatacttcgctgactaatatcgaagctgtattgcacccgctgccaacactgttaaacgctgctcgttgtgagtctggtaccccattcgattattatctggaggggattacgccatcagtcgggagtcttgcggagaaagtggacgctgaacgcatagcaatcgcaaaggctttcgatttaaacgttccgtcggtctgcgaatggcataaggcgagttacggccagtcaccggccacaatttatgaagcggtgcagggtaatcctgctctgcgcggcattatgggacctattggccttaacacggtgcacttcttcgaggatgtaagcaccggactggtaccgttatccgaactgggtcgggtggtgaatgtgcctaccccacttatcgatgctgttcttaccttgatcagttcgctgatagacacggatttcagaaaggaaggtcgtaccttggaaaaattaggtctgagcggacttaccgccgcgggcataagaagtgctgttgag

SEQ ID NO: 246 - protein, 359 aa, Artificial Sequence
  Engineered variant of opine dehydrogenase CENDH
MIESKTYAVLGLGNGGHAFAAYLALKGQRVLAWDIDAQRIKEIQDRGAIIAEGPGLAGTAHPDLLTDDIGLAVKDADVILIVVPAIHHASIAANIASYISEGQLIILNPGATGGALEFRKILRENGAPEVTIGETSSMLFTCRSERPGQVTVNAITGAMDFACLPAAKAGWALEQIGSVLPQYRAVENVLHTSLTNIEAVLHPLPTLLNAARCESGTPFDYYLEGITPSVGSLAEKVDAERIAIAKAFDLNVPSVCEWHKASYGQSPATIYEAVQGNPALRGIMGPIGLNTVHFFEDVSTGLVPLSELGRVVNVPTPLIDAVLTLISSLIDTDFRKEGRTLEKLGLSGLTAAGIRSAVE

SEQ ID NO: 247 - DNA, 1077 bp, Artificial Sequence
  Engineered variant of opine dehydrogenase CENDH
atgatcgagtcaaaaacatacgccgttttgggattaggaaacgggggtcacgcatttgccgcctatttagcattgaagggccagagtgtactggcttgggacatcgatgctcagagaatcaaagagattcaggaccgtggagccatcatagcggaaggaccaggacttgctgggactgctcacccggatcttctgaccgatgatataggtttggcggttaaagacgctgatgtgatactgattgtagtgccggccatccaccacgcttccattgcagcaaatatcgccagttacatttccgagggtcagttgattatccttaaccctggggcaacgggtggagcgctggaattccggaaaatcctgcgtgaaaatggtgcgccggaggtaacgatcggggaaacctcaagtatgctctttacatgccgctccgagagaccaggacaggttacggtaaatgcgataacacgtgccatggactttgcatgtctcccagcggcaaaagctggatgggccctggaacagatagggtcggttcttcctcaataccgtgctcgtgaaaacgtgttgcatacttcgctgactaatatcgaagctgtattgcacccgctgccaacactgttaaacgctgctcgttgtgagtctggtaccccattcgattattataccgaggggattacgccatcagtcgggagtcttgcggagaaagtggacgctgaacgcatagcaatcgcaaaggctttcgatttaaacgttccgtcggtctgcgaatggcataaggaaagttacggccagtcaccggccacaatttatgaagcggtgcagggtaatcctgctctgcgcggcattatgggacctattagccttaacacggtgcacttcttcgaggatgtaagcaccggactggtaccgttatccgaactgggtcgggcagtgaatgtgcctaccccacttatcgatgctgttcttgacttgatcagttcgctgatagacacggatttcagaaaggaaggtcgtaccttggaaaaattaggtctgagcggacttaccgccgcgggcataagaagtgctgttgag

SEQ ID NO: 248 - protein, 359 aa, Artificial Sequence
  Engineered variant of opine dehydrogenase CENDH
MIESKTYAVLGLGNGGHAFAAYLALKGQSVLAWDIDAQRIKEIQDRGAIIAEGPGLAGTAHPDLLTDDIGLAVKDADVILIVVPAIHHASIAANIASYISEGQLIILNPGATGGALEFRKILRENGAPEVTIGETSSMLFTCRSERPGQVTVNAITRAMDFACLPAAKAGWALEQIGSVLPQYRARENVLHTSLTNIEAVLHPLPTLLNAARCESGTPFDYYTEGITPSVGSLAEKVDAERIAIAKAFDLNVPSVCEWHKESYGQSPATIYEAVQGNPALRGIMGPISLNTVHFFEDVSTGLVPLSELGRAVNVPTPLIDAVLDLISSLIDTDFRKEGRTLEKLGLSGLTAAGIRSAVE

SEQ ID NO: 249 - DNA, 1077 bp, Artificial Sequence
  Engineered variant of opine dehydrogenase CENDH
atgatcgagtcaaaaacatacgccgttttgggattaggaaacgggggtcacgcatttgccgcctatttagcattgaagggccagagtgtactggcttgggacatcgatgctcagagaatcaaagagattcaggaccgtggagccatcatagcggaaggaccaggacttgctgggactgctcacccggatcttctgaccgatgatataggtttggcggttaaagacgctgatgtgatactgattgtagtgccggccatccaccacgcttccattgcagcaaatatcgccagttacatttccgagggtcagttgattatccttaaccctggggcaacgggtggagcgctggaattccggaaaatcctgcgtgaaaatggtgcgccggaggtaacgatcggggaaacctcaagtatgctctttacatgccgctccgagagaccaggacaggttacggtaaatgcgataacacgtgccatgaactttgcatgtctcccagcggcaaaagctggatgggccctggaacagatagggtcggttcttcctcaataccgtgctgtcgaaaacgtgttgcatacttcgctgactaatatcgaagctgtattgcacccgctgccaacactgttaaacgctgctcgttgtgagtctggtaccccattccaatattataccgaggggattacgccatcagtcgggagtcttgcggagaaagtggacgctgaacgcatagcaatcgcaaaggctttcgatttaaacgttccgtcggtctgcgaatggcataagagcagttacggccagtcaccggccacaatttatgaagcggtgcagggtaatcctgctctgcgcggcattgcgggacctaccaaccttaacacggtgcacttcttcgaggatgtaagcaccggactggtaccgttatccgaactgggtcgggcagtgaatgtgcctaccccacttatcgatgctgttcttgacttgatcagttcgctgatagacacggatttcagaaaggaaggtcgtaccttggaaaaattaggtctgagcggacttaccgccgcgggcataagaagtgctgttgag

SEQ ID NO: 250 - protein, 359 aa, Artificial Sequence
  Engineered variant of opine dehydrogenase CENDH
MIESKTYAVLGLGNGGHAFAAYLALKGQSVLAWDIDAQRIKEIQDRGAIIAEGPGLAGTAHPDLLTDDIGLAVKDADVILIVVPAIHHASIAANIASYISEGQLIILNPGATGGALEFRKILRENGAPEVTIGETSSMLFTCRSERPGQVTVNAITRAMNFACLPAAKAGWALEQIGSVLPQYRAVENVLHTSLTNIEAVLHPLPTLLNAARCESGTPFQYYTEGITPSVGSLAEKVDAERIAIAKAFDLNVPSVCEWHKSSYGQSPATIYEAVQGNPALRGIAGPTNLNTVHFFEDVSTGLVPLSELGRAVNVPTPLIDAVLDLISSLIDTDFRKEGRTLEKLGLSGLTAAGIRSAVE

SEQ ID NO: 251 - DNA, 1077 bp, Artificial Sequence
  Engineered variant of opine dehydrogenase CENDH
atgatcgagtcaaaaacatacgccgttttgggattaggaaacgggggtcacgcatttgccgcctatttagcattgaagggccagcgtgtactggcttgggacatcgatgctcagagaatcaaagagattcaggaccgtggagccatcatagcggaaggaccaggacttgctgggactgctcacccggatcttctgacctcagatataggtttggcggttaaagacgctgatgtgatactgattgtagtgccggccatccaccacgcttccattgcagcaaatatcgccagttacatttccgagggtcagttgattatccttaaccctggggcaacgggtggagcgctggaattccggaaaatcctgcgtgaaaatggtgcgccggaggtaacgatcggggaaacctcaagtatgctctttacatgccgctccgagagaccaggacaggttacggtaaatgcgataacaggcgccatggactttgcatgtctcccagcggcaaaagctggatgggccctggaacagatagggtcggttcttcctcaataccgtgctgtcgaaaacgtgttgcatacttcgctgactaatatcgaagctgtattgcacccgctgccaacactgttaaacgctgctcgttgtgagtctggtaccccattccaatattataccgaggggattacgccatcagtcgggagtcttgcggagaaagtggacgctgaacgcatagcaatcgcaaaggctttcgatttaaacgttccgtcggtctgcgaatggcataagagcagttacggccagtcaccggccacaatttatgaagcggtgcagggtaatcctgctctgcgcggcattatgggacctaccaaccttaacacggtgcacttcttcgaggatgtaagcaccggactggtaccgttatccgaactgggtcgggcagtgaatgtgcctaccccacttatcgatgctgttcttgacttgatcagttcgctgatagacacggatttcagaaaggaaggtcgtaccttggaaaaattaggtctgagcggacttaccgccgcgggcataagaagtgctgttgag

SEQ ID NO: 252 - protein, 359 aa, Artificial Sequence
  Engineered variant of opine dehydrogenase CENDH
MIESKTYAVLGLGNGGHAFAAYLALKGQRVLAWDIDAQRIKEIQDRGAIIAEGPGLAGTAHPDLLTSDIGLAVKDADVILIVVPAIHHASIAANIASYISEGQLIILNPGATGGALEFRKILRENGAPEVTIGETSSMLFTCRSERPGQVTVNAITGAMDFACLPAAKAGWALEQIGSVLPQYRAVENVLHTSLTNIEAVLHPLPTLLNAARCESGTPFQYYTEGITPSVGSLAEKVDAERIAIAKAFDLNVPSVCEWHKSSYGQSPATIYEAVQGNPALRGIMGPTNLNTVHFFEDVSTGLVPLSELGRAVNVPTPLIDAVLDLISSLIDTDFRKEGRTLEKLGLSGLTAAGIRSAVE

SEQ ID NO: 253 - DNA, 1077 bp, Artificial Sequence
  Engineered variant of opine dehydrogenase CENDH
atgatcgagtcaaaaacatacgccgttttgggattaggaaacgggggtcacgcatttgccgcctatttagcattgaagggccagagtgtactggcttgggacatcgatgctcagagaatcaaagagattcaggaccgtggagccatcatagcggaaggaccaggacttgctgggactgctcacccggatcttctgaccgatgatataggtttggcggttaaagacgctgatgtgatactgattgtagtgccggccatccaccacgcttccattgcagcaaatatcgccagttacatttccgagggtcagttgattatccttaaccctggggcaacgggtggagcgctggaattccggaaaatcctgcgtgaaaatggtgcgccggaggtaacgatcggggaaacctcaagtatgctctttacatgccgctccgagagaccaggacaggttacggtaaatgcgataacacgtgccatggactttgcatgtctcccagcggcaaaagctggatgggccctggaacagatagggtcggttcttcctcaataccgtgctaaagaaaacgtgttgcatacttcgctgactaatatcgaagctgtattgcacccgctgccaacactgttaaacgctgctcgttgtgagtctggtaccccattccaatattataccgaggggattacgccatcagtcgggagtcttgcggagaaagtggacgctgaacgcatagcaatcgcaaaggctttcgatttaaacgttccgtcggtctgcgaatggcataaggcgagttacggccagtcaccggccacaatttatgaagcggtgcagggtaatcctgctctgcgcggcattgcgggacctaccaaccttaacacggtgcacttcttcgaggatgtaagcaccggactggtaccgttatccgaactgggtcgggcagtgaatgtgcctaccccacttatcgatgctgttcttgacttgatcagttcgctgatagacacggatttcagaaaggaaggtcgtaccttggaaaaattaggtctgagcggacttaccgccgcgggcataagaagtgctgttgag

SEQ ID NO: 254 - protein, 359 aa, Artificial Sequence
  Engineered variant of opine dehydrogenase CENDH
MIESKTYAVLGLGNGGHAFAAYLALKGQSVLAWDIDAQRIKEIQDRGAIIAEGPGLAGTAHPDLLTDDIGLAVKDADVILIVVPAIHHASIAANIASYISEGQLIILNPGATGGALEFRKILRENGAPEVTIGETSSMLFTCRSERPGQVTVNAITRAMDFACLPAAKAGWALEQIGSVLPQYRAKENVLHTSLTNIEAVLHPLPTLLNAARCESGTPFQYYTEGITPSVGSLAEKVDAERIAIAKAFDLNVPSVCEWHKASYGQSPATIYEAVQGNPALRGIAGPTNLNTVHFFEDVSTGLVPLSELGRAVNVPTPLIDAVLDLISSLIDTDFRKEGRTLEKLGLSGLTAAGIRSAVE

SEQ ID NO: 255 - DNA, 1077 bp, Artificial Sequence
  Engineered variant of opine dehydrogenase CENDH
atgatcgagtcaaaaacatacgccgttttgggattaggaaacgggggtcacgcatttgccgcctatttagcattgaagggccagagtgtactggcttgggacatcgatgctcagagaatcaaagagattcaggaccgtggagccatcatagcggaaggaccaggacttgctgggactgctcacccggatcttctgaccgatgatataggtttggcggttaaagacgctgatgtgatactgattgtagtgccggccatccaccacgcttccattgcagcaaatatcgccagttacatttccgagggtcagttgattatccttaaccctggggcaacgggtggagcgctggaattccggaaaatcctgcgtgaaaatggtgcgccggaggtaacgatcggggaaacctcaagtatgctctttacatgccgctccgagagaccaggacaggttacggtaaatgcgataacacgtgccatggactttgcatgtctcccagcggcaaaagctggatgggccctggaacagatagggtcggttcttcctcaataccgtgctcgtgaaaacgtgttgcatacttcgctgactaatatcgaagctgtattgcacccgctgccaacactgttaaacgctgctcgttgtgagtctggtaccccattccaatattataccgaggggattacgccatcagtcgggagtcttgcggagaaagtggacgctgaacgcatagcaatcgcaaaggctttcgatttaaacgttccgtcggtctgcgaatggcataagcgtagttacggccagtcaccggccacaatttatgaagcggtgcagggtaatcctgctctgcgcggcattgcgggacctattagccttaacacggtgcacttcttcgaggatgtaagcaccggactggtaccgttatccgaactgggtcgggtggtgaatgtgcctaccccacttatcgatgctgttcttaccttgatcagttcgctgatagacacggatttcagaaaggaaggtcgtaccttggaaaaattaggtctgagcggacttaccgccgcgggcataagaagtgctgttgag

SEQ ID NO: 256 - protein, 359 aa, Artificial Sequence
  Engineered variant of opine dehydrogenase CENDH
MIESKTYAVLGLGNGGHAFAAYLALKGQSVLAWDIDAQRIKEIQDRGAIIAEGPGLAGTAHPDLLTDDIGLAVKDADVILIVVPAIHHASIAANIASYISEGQLIILNPGATGGALEFRKILRENGAPEVTIGETSSMLFTCRSERPGQVTVNAITRAMDFACLPAAKAGWALEQIGSVLPQYRARENVLHTSLTNIEAVLHPLPTLLNAARCESGTPFQYYTEGITPSVGSLAEKVDAERIAIAKAFDLNVPSVCEWHKRSYGQSPATIYEAVQGNPALRGIAGPISLNTVHFFEDVSTGLVPLSELGRVVNVPTPLIDAVLTLISSLIDTDFRKEGRTLEKLGLSGLTAAGIRSAVE

SEQ ID NO: 257 - DNA, 1077 bp, Artificial Sequence
  Engineered variant of opine dehydrogenase CENDH
atgatcgagtcaaaaacatacgccgttttgggattaggaaacgggggtcacgcatttgccgcctatttagcattgaagggccagagtgtactggcttgggacatcgatgctcagagaatcaaagagattcaggaccgtggagccatcatagcggaaggaccaggacttgctgggactgctcacccggatcttctgacctcagatataggtttggcggttaaagacgctgatgtgatactgattgtagtgccggccatccaccacgcttccattgcagcaaatatcgccagttacatttccgagggtcagttgattatccttaaccctggggcaacgggtggagcgctggaattccggaaaatcctgcgtgaaaatggtgcgccggaggtaacgatcggggaaacctcaagtatgctctttacatgccgctccgagagaccaggacaggttacggtaaatgcgataacaggcgccatggactttgcatgtctcccagcggcaaaagctggatgggccctggaacagatagggtcggttcttcctcaataccgtgctgtcgaaaacgtgttgcatacttcgctgactaatatcgaagctgtattgcacccgctgccaacactgttaaacgctgctcgttgtgagtctggtaccccattcgattattatctggaggggattacgccatcagtcgggagtcttgcggagaaagtggacgctgaacgcatagcaatcgcaaaggctttcgatttaaacgttccgtcggtctgcgaatggcataagaaaagttacggccagtcaccggccacaatttatgaagcggtgcagggtaatcctgctctgcgcggcattgcgggacctaccagccttaacacggtgcacttcttcgaggatgtaagcaccggactggtaccgttatccgaactgggtcgggcagtgaatgtgcctaccccacttatcgatgctgttcttgacttgatcagttcgctgatagacacggatttcagaaaggaaggtcgtaccttggaaaaattaggtctgagcggacttaccgccgcgggcataagaagtgctgttgag

SEQ ID NO: 258 - protein, 359 aa, Artificial Sequence
  Engineered variant of opine dehydrogenase CENDH
MIESKTYAVLGLGNGGHAFAAYLALKGQSVLAWDIDAQRIKEIQDRGAIIAEGPGLAGTAHPDLLTSDIGLAVKDADVILIVVPAIHHASIAANIASYISEGQLIILNPGATGGALEFRKILRENGAPEVTIGETSSMLFTCRSERPGQVTVNAITGAMDFACLPAAKAGWALEQIGSVLPQYRAVENVLHTSLTNIEAVLHPLPTLLNAARCESGTPFDYYLEGITPSVGSLAEKVDAERIAIAKAFDLNVPSVCEWHKKSYGQSPATIYEAVQGNPALRGIAGPTSLNTVHFFEDVSTGLVPLSELGRAVNVPTPLIDAVLDLISSLIDTDFRKEGRTLEKLGLSGLTAAGIRSAVE

SEQ ID NO: 259 - DNA, 1077 bp, Artificial Sequence
  Engineered variant of opine dehydrogenase CENDH
atgatcgagtcaaaaacatacgccgttttgggattaggaaacgggggtcacgcatttgccgcctatttagcattgaagggccagcgtgtactggcttgggacatcgatgctcagagaatcaaagagattcaggaccgtggagccatcatagcggaaggaccaggacttgctgggactgctcacccggatcttctgaccgatgatataggtttggcggttaaagacgctgatgtgatactgattgtagtgccggccatccaccacgcttccattgcagcaaatatcgccagttacatttccgagggtcagttgattatccttaaccctggggcaacgggtggagcgctggaattccggaaaatcctgcgtgaaaatggtgcgccggaggtaacgatcggggaaacctcaagtatgctctttacatgccgctccgagagaccaggacaggttacggtaaatgcgataacacgtgccatgaactttgcatgtctcccagcggcaaaagctggatgggccctggaacagatagggtcggttcttcctcaatacgtggctaaagaaaacgtgttgcatacttcgctgactaatatcgaagctgtattgcacccgctgccaacactgttaaacgctgctcgttgtgagtctggtaccccattccaatattatctggaggggattacgccatcagtcgggagtcttgcggagaaagtggacgctgaacgcatagcaatcgcaaaggctttcgatttaaacgttccgtcggtctgcgaatggcataagcgtagttacggccagtcaccggccacaatttatgaagcggtgcagggtaatcctgctctgcgcggcattgcgggacctaccaaccttaacacggtgcacttcttcgaggatgtaagcaccggactggtaccgttatccgaactgggtcgggtggtgaatgtgcctaccccacttatcgatgctgttcttgacttgatcagttcgctgatagacacggatttcagaaaggaaggtcgtaccttggaaaaattaggtctgagcggacttaccgccgcgggcataagaagtgctgttgag

SEQ ID NO: 260 - protein, 359 aa, Artificial Sequence
  Engineered variant of opine dehydrogenase CENDH
MIESKTYAVLGLGNGGHAFAAYLALKGQRVLAWDIDAQRIKEIQDRGAIIAEGPGLAGTAHPDLLTDDIGLAVKDADVILIVVPAIHHASIAANIASYISEGQLIILNPGATGGALEFRKILRENGAPEVTIGETSSMLFTCRSERPGQVTVNAITRAMNFACLPAAKAGWALEQIGSVLPQYVAKENVLHTSLTNIEAVLHPLPTLLNAARCESGTPFQYYLEGITPSVGSLAEKVDAERIAIAKAFDLNVPSVCEWHKRSYGQSPATIYEAVQGNPALRGIAGPTNLNTVHFFEDVSTGLVPLSELGRVVNVPTPLIDAVLDLISSLIDTDFRKEGRTLEKLGLSGLTAAGIRSAVE

SEQ ID NO: 261 - DNA, 1077 bp, Artificial Sequence
  Engineered variant of opine dehydrogenase CENDH
atgatcgagtcaaaaacatacgccgttttgggattaggaaacgggggtcacgcatttgccgcctatttagcattgaagggccagagtgtactggcttgggacatcgatgctcagagaatcaaagagattcaggaccgtggagccatcatagcggaaggaccaggacttgctgggactgctcacccggatcttctgaccgatgatataggtttggcggttaaagacgctgatgtgatactgattgtagtgccggccatccaccacgcttccattgcagcaaatatcgccagttacatttccgagggtcagttgattatccttaaccctggggcaacgggtggagcgctggaattccggaaaatcctgcgtgaaaatggtgcgccggaggtaacgatcggggaaacctcaagtatgctctttacatgccgctccgagagaccaggacaggttacggtaaatgcgataacaggcgccatggactttgcatgtctcccagcggcaaaagctggatgggccctggaacagatagggtcggttcttcctcaatacgtggctaaagaaaacgtgttgcatacttcgctgactaatatcgaagctgtattgcacccgctgccaacactgttaaacgctgctcgttgtgagtctggtaccccattccaatattataccgaggggattacgccatcagtcgggagtcttgcggagaaagtggacgctgaacgcatagcaatcgcaaaggctttcgatttaaacgttccgtcggtctgcgaatggcataagagcagttacggccagtcaccggccacaatttatgaagcggtgcagggtaatcctgctctgcgcggcattatgggacctaccggccttaacacggtgcacttcttcgaggatgtaagcaccggactggtaccgttatccgaactgggtcgggtggtgaatgtgcctaccccacttatcgatgctgttcttaccttgatcagttcgctgatagacacggatttcagaaaggaaggtcgtaccttggaaaaattaggtctgagcggacttaccgccgcgggcataagaagtgctgttgag

SEQ ID NO: 262 - protein, 359 aa, Artificial Sequence
  Engineered variant of opine dehydrogenase CENDH
MIESKTYAVLGLGNGGHAFAAYLALKGQSVLAWDIDAQRIKEIQDRGAIIAEGPGLAGTAHPDLLTDDIGLAVKDADVILIVVPAIHHASIAANIASYISEGQLIILNPGATGGALEFRKILRENGAPEVTIGETSSMLFTCRSERPGQVTVNAITGAMDFACLPAAKAGWALEQIGSVLPQYVAKENVLHTSLTNIEAVLHPLPTLLNAARCESGTPFQYYTEGITPSVGSLAEKVDAERIAIAKAFDLNVPSVCEWHKSSYGQSPATIYEAVQGNPALRGIMGPTGLNTVHFFEDVSTGLVPLSELGRVVNVPTPLIDAVLTLISSLIDTDFRKEGRTLEKLGLSGLTAAGIRSAVE

SEQ ID NO: 263 - DNA, 1077 bp, Artificial Sequence
  Engineered variant of opine dehydrogenase CENDH
atgatcgagtcaaaaacatacgccgttttgggattaggaaacgggggtcacgcatttgccgcctatttagcattgaagggccagcgtgtactggcttgggacatcgatgctcagagaatcaaagagattcaggaccgtggagccatcatagcggaaggaccaggacttgctgggactgctcacccggatcttctgacctcagatataggtttggcggttaaagacgctgatgtgatactgattgtagtgccggccatccaccacgcttccattgcagcaaatatcgccagttacatttccgagggtcagttgattatccttaaccctggggcaacgggtggagcgctggaattccggaaaatcctgcgtgaaaatggtgcgccggaggtaacgatcggggaaacctcaagtatgctctttacatgccgctccgagagaccaggacaggttacggtaaatgcgataacaggcgccatggactttgcatgtctcccagcggcaaaagctggatgggccctggaacagatagggtcggttcttcctcaatacgtggctgtcgaaaacgtgttgcatacttcgctgactaatatcgaagctgtattgcacccgctgccaacactgttaaacgctgctcgttgtgagtctggtaccccattccaatattataccgaggggattacgccatcagtcgggagtcttgcggagaaagtggacgctgaacgcatagcaatcgcaaaggctttcgatttaaacgttccgtcggtctgcgaatggcataaggaaagttacggccagtcaccggccacaatttatgaagcggtgcagggtaatcctgctctgcgcggcattgcgggacctaccagccttaacacggtgcacttcttcgaggatgtaagcaccggactggtaccgttatccgaactgggtcgggtggtgaatgtgcctaccccacttatcgatgctgttcttaccttgatcagttcgctgatagacacggatttcagaaaggaaggtcgtaccttggaaaaattaggtctgagcggacttaccgccgcgggcataagaagtgctgttgag

SEQ ID NO: 264 - protein, 359 aa, Artificial Sequence
  Engineered variant of opine dehydrogenase CENDH
MIESKTYAVLGLGNGGHAFAAYLALKGQRVLAWDIDAQRIKEIQDRGAIIAEGPGLAGTAHPDLLTSDIGLAVKDADVILIVVPAIHHASIAANIASYISEGQLIILNPGATGGALEFRKILRENGAPEVTIGETSSMLFTCRSERPGQVTVNAITGAMDFACLPAAKAGWALEQIGSVLPQYVAVENVLHTSLTNIEAVLHPLPTLLNAARCESGTPFQYYTEGITPSVGSLAEKVDAERIAIAKAFDLNVPSVCEWHKESYGQSPATIYEAVQGNPALRGIAGPTSLNTVHFFEDVSTGLVPLSELGRVVNVPTPLIDAVLTLISSLIDTDFRKEGRTLEKLGLSGLTAAGIRSAVE

SEQ ID NO: 265 - DNA, 1077 bp, Artificial Sequence
  Engineered variant of opine dehydrogenase CENDH
atgatcgagtcaaaaacatacgccgttttgggattaggaaacgggggtcacgcatttgccgcctatttagcattgaagggccagcgtgtactggcttgggacatcgatgctcagagaatcaaagagattcaggaccgtggagccatcatagcggaaggaccaggacttgctgggactgctcacccggatcttctgaccgatgatataggtttggcggttaaagacgctgatgtgatactgattgtagtgccggccatccaccacgcttccattgcagcaaatatcgccagttacatttccgagggtcagttgattatccttaaccctggggcaacgggtggagcgctggaattccggaaaatcctgcgtgaaaatggtgcgccggaggtaacgatcggggaaacctcaagtatgctctttacatgccgctccgagagaccaggacaggttacggtaaatgcgataacacgtgccatggactttgcatgtctcccagcggcaaaagctggatgggccctggaacagatagggtcggttcttcctcaataccgtgctgtcgaaaacgtgttgcatacttcgctgactaatatcgaagctgtattgcacccgctgccaacactgttaaacgctgctcgttgtgagtctggtaccccattccaatattataccgaggggattacgccatcagtcgggagtcttgcggagaaagtggacgctgaacgcatagcaatcgcaaaggctttcgatttaaacgttccgtcggtctgcgaatggcataagagcagttacggccagtcaccggccacaatttatgaagcggtgcagggtaatcctgctctgcgcggcattgcgggacctaccagccttaacacggtgcacttcttcgaggatgtaagcaccggactggtaccgttatccgaactgggtcgggcagtgaatgtgcctaccccacttatcgatgctgttcttgacttgatcagttcgctgatagacacggatttcagaaaggaaggtcgtaccttggaaaaattaggtctgagcggacttaccgccgcgggcataagaagtgctgttgag

SEQ ID NO: 266 - protein, 359 aa, Artificial Sequence
  Engineered variant of opine dehydrogenase CENDH
MIESKTYAVLGLGNGGHAFAAYLALKGQRVLAWDIDAQRIKEIQDRGAIIAEGPGLAGTAHPDLLTDDIGLAVKDADVILIVVPAIHHASIAANIASYISEGQLIILNPGATGGALEFRKILRENGAPEVTIGETSSMLFTCRSERPGQVTVNAITRAMDFACLPAAKAGWALEQIGSVLPQYRAVENVLHTSLTNIEAVLHPLPTLLNAARCESGTPFQYYTEGITPSVGSLAEKVDAERIAIAKAFDLNVPSVCEWHKSSYGQSPATIYEAVQGNPALRGIAGPTSLNTVHFFEDVSTGLVPLSELGRAVNVPTPLIDAVLDLISSLIDTDFRKEGRTLEKLGLSGLTAAGIRSAVE

SEQ ID NO: 267 - DNA, 1077 bp, Artificial Sequence
  Engineered variant of opine dehydrogenase CENDH
atgatcgagtcaaaaacatacgccgttttgggattaggaaacgggggtcacgcatttgccgcctatttagcattgaagggccagcgtgtactggcttgggacatcgatgctcagagaatcaaagagattcaggaccgtggagccatcatagcggaaggaccaggacttgctgggactgctcacccggatcttctgaccgatgatataggtttggcggttaaagacgctgatgtgatactgattgtagtgccggccatccaccacgcttccattgcagcaaatatcgccagttacatttccgagggtcagttgattatccttaaccctggggcaacgggtggagcgctggaattccggaaaatcctgcgtgaaaatggtgcgccggaggtaacgatcggggaaacctcaagtatgctctttacatgccgctccgagagaccaggacaggttacggtaaatgcgataacacgtgccatgaactttgcatgtctcccagcggcaaaagctggatgggccctggaacagatagggtcggttcttcctcaatacgtggctaaagaaaacgtgttgcatacttcgctgactaatatcgaagctgtattgcacccgctgccaacactgttaaacgctgctcgttgtgagtctggtaccccattccaatattataccgaggggattacgccatcagtcgggagtcttgcggagaaagtggacgctgaacgcatagcaatcgcaaaggctttcgatttaaacgttccgtcggtctgcgaatggcataagaaaagttacggccaatcaccggccacaatttatgaagcggtgcagggtaatcctgctctgcgcggcattatgggacctattagccttaacacggtgcacttcttcgaggatgtaagcaccggactggtaccgttatccgaactgggtcgggtggtgaatgtgcctaccccacttatcgatgctgttcttaccttgatcagttcgctgatagacacggatttcagaaaggaaggtcgtaccttggaaaaattaggtctgagcggacttaccgccgcgggcataagaagtgctgttgag

SEQ ID NO: 268 - protein, 359 aa, Artificial Sequence
  Engineered variant of opine dehydrogenase CENDH
MIESKTYAVLGLGNGGHAFAAYLALKGQRVLAWDIDAQRIKEIQDRGAIIAEGPGLAGTAHPDLLTDDIGLAVKDADVILIVVPAIHHASIAANIASYISEGQLIILNPGATGGALEFRKILRENGAPEVTIGETSSMLFTCRSERPGQVTVNAITRAMNFACLPAAKAGWALEQIGSVLPQYVAKENVLHTSLTNIEAVLHPLPTLLNAARCESGTPFQYYTEGITPSVGSLAEKVDAERIAIAKAFDLNVPSVCEWHKKSYGQSPATIYEAVQGNPALRGIMGPISLNTVHFFEDVSTGLVPLSELGRVVNVPTPLIDAVLTLISSLIDTDFRKEGRTLEKLGLSGLTAAGIRSAVE

SEQ ID NO: 269 - DNA, 1077 bp, Artificial Sequence
  Engineered variant of opine dehydrogenase CENDH
atgatcgagtcaaaaacatacgccgttttgggattaggaaacgggggtcacgcatttgccgcctatttagcattgaagggccagcgtgtactggcttgggacatcgatgctcagagaatcaaagagattcaggaccgtggagccatcatagcggaaggaccaggacttgctgggactgctcacccggatcttctgaccgatgatataggtttggcggttaaagacgctgatgtgatactgattgtagtgccggccatccaccacgcttccattgcagcaaatatcgccagttacatttccgagggtcagttgattatccttaaccctggggcaacgggtggagcgctggaattccggaaaatcctgcgtgaaaatggtgcgccggaggtaacgatcggggaaacctcaagtatgctctttacatgccgctccgagagaccaggacaggttacggtaaatgcgataacacgtgccatggactttgcatgtctcccagcggcaaaagctggatgggccctggaacagatagggtcggttcttcctcaatacgtggctaaagaaaacgtgttgcatacttcgctgactaatatcgaagctgtattgcacccgctgccaacactgttaaacgctgctcgttgtgagtctggtaccccattccaatattataccgaggggattacgccatcagtcgggagtcttgcggagaaagtggacgctgaacgcatagcaatcgcaaaggctttcgatttaaacgttccgtcggtctgcgaatggcataaggcgagttacggccagtcaccggccacaatttatgaagcggtgcagggtaatcctgctctgcgcggcattgcgggacctaccagccttaacacggtgcacttcttcgaggatgtaagcaccggactggtaccgttatccgaactgggtcgggtggtgaatgtgcctaccccacttatcgatgctgttcttgacttgatcagttcgctgatagacacggatttcagaaaggaaggtcgtaccttggaaaaattaggtctgagcggacttaccgccgcgggcataagaagtgctgttgag

SEQ ID NO: 270 - protein, 359 aa, Artificial Sequence
  Engineered variant of opine dehydrogenase CENDH
MIESKTYAVLGLGNGGHAFAAYLALKGQRVLAWDIDAQRIKEIQDRGAIIAEGPGLAGTAHPDLLTDDIGLAVKDADVILIVVPAIHHASIAANIASYISEGQLIILNPGATGGALEFRKILRENGAPEVTIGETSSMLFTCRSERPGQVTVNAITRAMDFACLPAAKAGWALEQIGSVLPQYVAKENVLHTSLTNIEAVLHPLPTLLNAARCESGTPFQYYTEGITPSVGSLAEKVDAERIAIAKAFDLNVPSVCEWHKASYGQSPATIYEAVQGNPALRGIAGPTSLNTVHFFEDVSTGLVPLSELGRVVNVPTPLIDAVLDLISSLIDTDFRKEGRTLEKLGLSGLTAAGIRSAVE

SEQ ID NO: 271 - DNA, 1077 bp, Artificial Sequence
  Engineered variant of opine dehydrogenase CENDH
atgatcgagtcaaaaacatacgccgttttgggattaggaaacgggggtcacgcatttgccgcctatttagcattgaagggccagagtgtactggcttgggacatcgatgctcagagaatcaaagagattcaggaccgtggagccatcatagcggaaggaccaggacttgctgggactgctcacccggatcttctgaccgatgatataggtttggcggttaaagacgctgatgtgatactgattgtagtgccggccatccaccacgcttccattgcagcaaatatcgccagttacatttccgagggtcagttgattatccttaaccctggggcaacgggtggagcgctggaattccggaaaatcctgcgtgaaaatggtgcgccggaggtaacgatcggggaaacctcaagtatgctctttacatgccgctccgagagaccaggacaggttacggtaaatgcgataacacgtgccatgaactttgcatgtctcccagcggcaaaagctggatgggccctggaacagatagggtcggttcttcctcaatacgtggctcgtgaaaacgtgttgcatacttcgctgactaatatcgaagctgtattgcacccgctgccaacactgttaaacgctgctcgttgtgagtctggtaccccattccaatattataccgaggggattacgccatcagtcgggagtcttgcggagaaagtggacgctgaacgcatagcaatcgcaaaggctttcgatttaaacgttccgtcggtctgcgaatggcataagagcagttacggccagtcaccggccacaatttatgaagcggtgcagggtaatcctgctctgcgcggcattatgggacctaccggccttaacacggtgcacttcttcgaggatgtaagcaccggactggtaccgttatccgaactgggtcgggtggtgaatgtgcctaccccacttatcgatgctgttcttgacttgatcagttcgctgatagacacggatttcagaaaggaaggtcgtaccttggaaaaattaggtctgagcggacttaccgccgcgggcataagaagtgctgttgag

SEQ ID NO: 272 - protein, 359 aa, Artificial Sequence
  Engineered variant of opine dehydrogenase CENDH
MIESKTYAVLGLGNGGHAFAAYLALKGQSVLAWDIDAQRIKEIQDRGAIIAEGPGLAGTAHPDLLTDDIGLAVKDADVILIVVPAIHHASIAANIASYISEGQLIILNPGATGGALEFRKILRENGAPEVTIGETSSMLFTCRSERPGQVTVNAITRAMNFACLPAAKAGWALEQIGSVLPQYVARENVLHTSLTNIEAVLHPLPTLLNAARCESGTPFQYYTEGITPSVGSLAEKVDAERIAIAKAFDLNVPSVCEWHKSSYGQSPATIYEAVQGNPALRGIMGPTGLNTVHFFEDVSTGLVPLSELGRVVNVPTPLIDAVLDLISSLIDTDFRKEGRTLEKLGLSGLTAAGIRSAVE

SEQ ID NO: 273 - DNA, 1077 bp, Artificial Sequence
  Engineered variant of opine dehydrogenase CENDH
atgatcgagtcaaaaacatacgccgttttgggattaggaaacgggggtcacgcatttgccgcctatttagcattgaagggccagagtgtactggcttgggacatcgatgctcagagaatcaaagagattcaggaccgtggagccatcatagcggaaggaccaggacttgctgggactgctcacccggatcttctgaccgatgatataggtttggcggttaaagacgctgatgtgatactgattgtagtgccggccatccaccacgcttccattgcagcaaatatcgccagttacatttccgagggtcagttgattatccttaaccctggggcaacgggtggagcgctggaattccggaaaatcctgcgtgaaaatggtgcgccggaggtaacgatcggggaaacctcaagtatgctctttacatgccgctccgagagaccaggacaggttacggtaaatgcgataacaggcgccatgaactttgcatgtctcccagcggcaaaagctggatgggccctggaacagatagggtcggttcttcctcaatacgtggctcgtgaaaacgtgttgcatacttcgctgactaatatcgaagctgtattgcacccgctgccaacactgttaaacgctgctcgttgtgagtctggtaccccattccaatattataccgaggggattacgccatcagtcgggagtcttgcggagaaagtggacgctgaacgcatagcaatcgcaaaggctttcgatttaaacgttccgtcggtctgcgaatggcataaggaaagttacggccagtcaccggccacaatttatgaagcggtgcagggtaatcctgctctgcgcggcattatgggacctattggccttaacacggtgcacttcttcgaggatgtaagcaccggactggtaccgttatccgaactgggtcgggcagtgaatgtgcctaccccacttatcgatgctgttcttgacttgatcagttcgctgatagacacggatttcagaaaggaaggtcgtaccttggaaaaattaggtctgagcggacttaccgccgcgggcataagaagtgctgttgag

SEQ ID NO: 274 - protein, 359 aa, Artificial Sequence
  Engineered variant of opine dehydrogenase CENDH
MIESKTYAVLGLGNGGHAFAAYLALKGQSVLAWDIDAQRIKEIQDRGAIIAEGPGLAGTAHPDLLTDDIGLAVKDADVILIVVPAIHHASIAANIASYISEGQLIILNPGATGGALEFRKILRENGAPEVTIGETSSMLFTCRSERPGQVTVNAITGAMNFACLPAAKAGWALEQIGSVLPQYVARENVLHTSLTNIEAVLHPLPTLLNAARCESGTPFQYYTEGITPSVGSLAEKVDAERIAIAKAFDLNVPSVCEWHKESYGQSPATIYEAVQGNPALRGIMGPIGLNTVHFFEDVSTGLVPLSELGRAVNVPTPLIDAVLDLISSLIDTDFRKEGRTLEKLGLSGLTAAGIRSAVE

SEQ ID NO: 275 - DNA, 1077 bp, Artificial Sequence
  Engineered variant of opine dehydrogenase CENDH
atgatcgagtcaaaaacatacgccgttttgggattaggaaacgggggtcacgcatttgccgcctatttagcattgaagggccagagtgtactggcttgggacatcgatgctcagagaatcaaagagattcaggaccgtggagccatcatagcggaaggaccaggacttgctgggactgctcacccggatcttctgaccgatgatataggtttggcggttaaagacgctgatgtgatactgattgtagtgccggccatccaccacgcttccattgcagcaaatatcgccagttacatttccgagggtcagttgattatccttaaccctggggcaacgggtggagcgctggaattccggaaaatcctgcgtgaaaatggtgcgccggaggtaacgatcggggaaacctcaagtatgctctttacatgccgctccgagagaccaggacaggttacggtaaatgcgataacacgtgccatggactttgcatgtctcccagcggcaaaagctggatgggccctggaacagatagggtcggttcttcctcaatacgtggctgtcgaaaacgtgttgcatacttcgctgactaatatcgaagctgtattgcacccgctgccaacactgttaaacgctgctcgttgtgagtctggtaccccattccaatattataccgaggggattacgccatcagtcgggagtcttgcggagaaagtggacgctgaacgcatagcaatcgcaaaggctttcgatttaaacgttccgtcggtctgcgaatggcataaggcgagttacggccagtcaccggccacaatttatgaagcggtgcagggtaatcctgctctgcgcggcattgcgggacctaccaaccttaacacggtgcacttcttcgaggatgtaagcaccggactggtaccgttatccgaactgggtcgggcagtgaatgtgcctaccccacttatcgatgctgttcttaccttgatcagttcgctgatagacacggatttcagaaaggaaggtcgtaccttggaaaaattaggtctgagcggacttaccgccgcgggcataagaagtgctgttgag

SEQ ID NO: 276 - protein, 359 aa, Artificial Sequence
  Engineered variant of opine dehydrogenase CENDH
MIESKTYAVLGLGNGGHAFAAYLALKGQSVLAWDIDAQRIKEIQDRGAIIAEGPGLAGTAHPDLLTDDIGLAVKDADVILIVVPAIHHASIAANIASYISEGQLIILNPGATGGALEFRKILRENGAPEVTIGETSSMLFTCRSERPGQVTVNAITRAMDFACLPAAKAGWALEQIGSVLPQYVAVENVLHTSLTNIEAVLHPLPTLLNAARCESGTPFQYYTEGITPSVGSLAEKVDAERIAIAKAFDLNVPSVCEWHKASYGQSPATIYEAVQGNPALRGIAGPTNLNTVHFFEDVSTGLVPLSELGRAVNVPTPLIDAVLTLISSLIDTDFRKEGRTLEKLGLSGLTAAGIRSAVE

SEQ ID NO: 277 - DNA, 1077 bp, Artificial Sequence
  Engineered variant of opine dehydrogenase CENDH
atgatcgagtcaaaaacatacgccgttttgggattaggaaacgggggtcacgcatttgccgcctatttagcattgaagggccagcgtgtactggcttgggacatcgatgctcagagaatcaaagagattcaggaccgtggagccatcatagcggaaggaccaggacttgctgggactgctcacccggatcttctgaccgatgatataggtttggcggttaaagacgctgatgtgatactgattgtagtgccggccatccaccacgcttccattgcagcaaatatcgccagttacatttccgagggtcagttgattatccttaaccctggggcaacgggtggagcgctggaattccggaaaatcctgcgtgaaaatggtgcgccggaggtaacgatcggggaaacctcaagtatgctctttacatgccgctccgagagaccaggacaggttacggtaaatgcgataacacgtgccatggactttgcatgtctcccagcggcaaaagctggatgggccctggaacagatagggtcggttcttcctcaataccgtgctgtcgaaaacgtgttgcatacttcgctgactaatatcgaagctgtattgcacccgctgccaacactgttaaacgctgctcgttgtgagtctggtaccccattccaatattataccgaggggattacgccatcagtcgggagtcttgcggagaaagtggacgctgaacgcatagcaatcgcaaaggctttcgatttaaacgttccgtcggtctgcgaatggcataagcgtagttacggccagtcaccggccacaatttatgaagcggtgcagggtaatcctgctctgcgcggcattatgggacctattagccttaacacggtgcacttcttcgaggatgtaagcaccggactggtaccgttatccgaactgggtcgggcagtgaatgtgcctaccccacttatcgatgctgttcttgacttgatcagttcgctgatagacacggatttcagaaaggaaggtcgtaccttggaaaaattaggtctgagcggacttaccgccgcgggcataagaagtgctgttgag

SEQ ID NO: 278 - protein, 359 aa, Artificial Sequence
  Engineered variant of opine dehydrogenase CENDH
MIESKTYAVLGLGNGGHAFAAYLALKGQRVLAWDIDAQRIKEIQDRGAIIAEGPGLAGTAHPDLLTDDIGLAVKDADVILIVVPAIHHASIAANIASYISEGQLIILNPGATGGALEFRKILRENGAPEVTIGETSSMLFTCRSERPGQVTVNAITRAMDFACLPAAKAGWALEQIGSVLPQYRAVENVLHTSLTNIEAVLHPLPTLLNAARCESGTPFQYYTEGITPSVGSLAEKVDAERIAIAKAFDLNVPSVCEWHKRSYGQSPATIYEAVQGNPALRGIMGPISLNTVHFFEDVSTGLVPLSELGRAVNVPTPLIDAVLDLISSLIDTDFRKEGRTLEKLGLSGLTAAGIRSAVE

SEQ ID NO: 279 - DNA, 1077 bp, Artificial Sequence
  Engineered variant of opine dehydrogenase CENDH
atgatcgagtcaaaaacatacgccgttttgggattaggaaacgggggtcacgcatttgccgcctatttagcattgaagggccagagtgtactggcttgggacatcgatgctcagagaatcaaagagattcaggaccgtggagccatcatagcggaaggaccaggacttgctgggactgctcacccggatcttctgaccgatgatataggtttggcggttaaagacgctgatgtgatactgattgtagtgccggccatccaccacgcttccattgcagcaaatatcgccagttacatttccgagggtcagttgattatccttaaccctggggcaacgggtggagcgctggaattccggaaaatcctgcgtgaaaatggtgcgccggaggtaacgatcggggaaacctcaagtatgctctttacatgccgctccgagagaccaggacaggttacggtaaatgcgataacacgtgccatggactttgcatgtctcccagcggcaaaagctggatgggccctggaacagatagggtcggttcttcctcaataccgtgctcgtgaaaacgtgttgcatacttcgctgactaatatcgaagctgtattgcacccgctgccaacactgttaaacgctgctcgttgtgagtctggtaccccattcgattattatctggaggggattacgccatcagtcgggagtcttgcggagaaagtggacgctgaacgcatagcaatcgcaaaggctttcgatttaaacgttccgtcggtctgcgaatggcataagagcagttacggccagtcaccggccacaatttatgaagcggtgcagggtaatcctgctctgcgcggcattgcgggacctaccggccttaacacggtgcacttcttcgaggatgtaagcaccggactggtaccgttatccgaactgggtcgggcagtgaatgtgcctaccccacttatcgatgctgttcttgacttgatcagttcgctgatagacacggatttcagaaaggaaggtcgtaccttggaaaaattaggtctgagcggacttaccgccgcgggcataagaagtgctgttgag

SEQ ID NO: 280 - protein, 359 aa, Artificial Sequence
  Engineered variant of opine dehydrogenase CENDH
MIESKTYAVLGLGNGGHAFAAYLALKGQSVLAWDIDAQRIKEIQDRGAIIAEGPGLAGTAHPDLLTDDIGLAVKDADVILIVVPAIHHASIAANIASYISEGQLIILNPGATGGALEFRKILRENGAPEVTIGETSSMLFTCRSERPGQVTVNAITRAMDFACLPAAKAGWALEQIGSVLPQYRARENVLHTSLTNIEAVLHPLPTLLNAARCESGTPFDYYLEGITPSVGSLAEKVDAERIAIAKAFDLNVPSVCEWHKSSYGQSPATIYEAVQGNPALRGIAGPTGLNTVHFFEDVSTGLVPLSELGRAVNVPTPLIDAVLDLISSLIDTDFRKEGRTLEKLGLSGLTAAGIRSAVE

SEQ ID NO: 281 - DNA, 1077 bp, Artificial Sequence
  Engineered variant of opine dehydrogenase CENDH
atgatcgagtcaaaaacatacgccgttttgggattaggaaacgggggtcacgcatttgccgcctatttagcattgaagggccagagtgtactggcttgggacatcgatgctcagagaatcaaagagattcaggaccgtggagccatcatagcggaaggaccaggacttgctgggactgctcacccggatcttctgaccgatgatataggtttggcggttaaagacgctgatgtgatactgattgtagtgccggccatccaccacgcttccattgcagcaaatatcgccagttacatttccgagggtcagttgattatccttaaccctggggcaacgggtggagcgctggaattccggaaaatcctgcgtgaaaatggtgcgccggaggtaacgatcggggaaacctcaagtatgctctttacatgccgctccgagagaccaggacaggttacggtaaatgcgataacacgtgccatggactttgcatgtctcccagcggcaaaagctggatgggccctggaacagatagggtcggttcttcctcaatacgtggctaaagaaaacgtgttgcatacttcgctgactaatatcgaagctgtattgcacccgctgccaacactgttaaacgctgctcgttgtgagtctggtaccccattccaatattatctggaggggattacgccatcagtcgggagtcttgcggagaaagtggacgctgaacgcatagcaatcgcaaaggctttcgatttaaacgttccgtcggtctgcgaatggcataaggcgagttacggccagtcaccggccacaatttatgaagcggtgcagggtaatcctgctctgcgcggcattgcgggacctaccagccttaacacggtgcacttcttcgaggatgtaagcaccggactggtaccgttatccgaactgggtcgggcagtgaatgtgcctaccccacttatcgatgctgttcttaccttgatcagttcgctgatagacacggatttcagaaaggaaggtcgtaccttggaaaaattaggtctgagcggacttaccgccgcgggcataagaagtgctgttgag

SEQ ID NO: 282 - protein, 359 aa, Artificial Sequence
  Engineered variant of opine dehydrogenase CENDH
MIESKTYAVLGLGNGGHAFAAYLALKGQSVLAWDIDAQRIKEIQDRGAIIAEGPGLAGTAHPDLLTDDIGLAVKDADVILIVVPAIHHASIAANIASYISEGQLIILNPGATGGALEFRKILRENGAPEVTIGETSSMLFTCRSERPGQVTVNAITRAMDFACLPAAKAGWALEQIGSVLPQYVAKENVLHTSLTNIEAVLHPLPTLLNAARCESGTPFQYYLEGITPSVGSLAEKVDAERIAIAKAFDLNVPSVCEWHKASYGQSPATIYEAVQGNPALRGIAGPTSLNTVHFFEDVSTGLVPLSELGRAVNVPTPLIDAVLTLISSLIDTDFRKEGRTLEKLGLSGLTAAGIRSAVE

SEQ ID NO: 283 - DNA, 1077 bp, Artificial Sequence
  Engineered variant of opine dehydrogenase CENDH
atgatcgagtcaaaaacatacgccgttttgggattaggaaacgggggtcacgcatttgccgcctatttagcattgaagggccagagtgtactggcttgggacatcgatgctcagagaatcaaagagattcaggaccgtggagccatcatagcggaaggaccaggacttgctgggactgctcacccggatcttctgaccgatgatataggtttggcggttaaagacgctgatgtgatactgattgtagtgccggccatccaccacgcttccattgcagcaaatatcgccagttacatttccgagggtcagttgattatccttaaccctggggcaacgggtggagcgctggaattccggaaaatcctgcgtgaaaatggtgcgccggaggtaacgatcggggaaacctcaagtatgctctttacatgccgctccgagagaccaggacaggttacggtaaatgcgataacacgtgccatggactttgcatgtctcccagcggcaaaagctggatgggccctggaacagatagggtcggttcttcctcaataccgtgctgtcgaaaacgtgttgcatacttcgctgactaatatcgaagctgtattgcacccgctgccaacactgttaaacgctgctcgttgtgagtctggtaccccattcgattattatctggaggggattacgccatcagtcgggagtcttgcggagaaagtggacgctgaacgcatagcaatcgcaaaggctttcgatttaaacgttccgtcggtctgcgaatggcataaggaaagttacggccagtcaccggccacaatttatgaagcggtgcagggtaatcctgctctgcgcggcattgcgggacctattagccttaacacggtgcacttcttcgaggatgtaagcaccggactggtaccgttatccgaactgggtcgggtggtgaatgtgcctaccccacttatcgatgctgttcttgacttgatcagttcgctgatagacacggatttcagaaaggaaggtcgtaccttggaaaaattaggtctgagcggacttaccgccgcgggcataagaagtgctgttgag

SEQ ID NO: 284 - protein, 359 aa, Artificial Sequence
  Engineered variant of opine dehydrogenase CENDH
MIESKTYAVLGLGNGGHAFAAYLALKGQSVLAWDIDAQRIKEIQDRGAIIAEGPGLAGTAHPDLLTDDIGLAVKDADVILIVVPAIHHASIAANIASYISEGQLIILNPGATGGALEFRKILRENGAPEVTIGETSSMLFTCRSERPGQVTVNAITRAMDFACLPAAKAGWALEQIGSVLPQYRAVENVLHTSLTNIEAVLHPLPTLLNAARCESGTPFDYYLEGITPSVGSLAEKVDAERIAIAKAFDLNVPSVCEWHKESYGQSPATIYEAVQGNPALRGIAGPISLNTVHFFEDVSTGLVPLSELGRVVNVPTPLIDAVLDLISSLIDTDFRKEGRTLEKLGLSGLTAAGIRSAVE

SEQ ID NO: 285 - DNA, 1077 bp, Artificial Sequence
  Engineered variant of opine dehydrogenase CENDH
atgatcgagtcaaaaacatacgccgttttgggattaggaaacgggggtcacgcatttgccgcctatttagcattgaagggccagagtgtactggcttgggacatcgatgctcagagaatcaaagagattcaggaccgtggagccatcatagcggaaggaccaggacttgctgggactgctcacccggatcttctgaccgatgatataggtttggcggttaaagacgctgatgtgatactgattgtagtgccggccatccaccacgcttccattgcagcaaatatcgccagttacatttccgagggtcagttgattatccttaaccctggggcaacgggtggagcgctggaattccggaaaatcctgcgtgaaaatggtgcgccggaggtaacgatcggggaaacctcaagtatgctctttacatgccgctccgagagaccaggacaggttacggtaaatgcgataacaggcgccatggactttgcatgtctcccagcggcaaaagctggatgggccctggaacagatagggtcggttcttcctcaatacgtggctgtcgaaaacgtgttgcatacttcgctgactaatatcgaagctgtattgcacccgctgccaacactgttaaacgctgctcgttgtgagtctggtaccccattccaatattatctggaggggattacgccatcagtcgggagtcttgcggagaaagtggacgctgaacgcatagcaatcgcaaaggctttcgatttaaacgttccgtcggtctgcgaatggcataagagcagttacggccagtcaccggccacaatttatgaagcggtgcagggtaatcctgctctgcgcggcattgcgggacctattagccttaacacggtgcacttcttcgaggatgtaagcaccggactggtaccgttatccgaactgggtcgggcagtgaatgtgcctaccccacttatcgatgctgttcttgacttgatcagttcgctgatagacacggatttcagaaaggaaggtcgtaccttggaaaaattaggtctgagcggacttaccgccgcgggcataagaagtgctgttgag

SEQ ID NO: 286 - protein, 359 aa, Artificial Sequence
  Engineered variant of opine dehydrogenase CENDH
MIESKTYAVLGLGNGGHAFAAYLALKGQSVLAWDIDAQRIKEIQDRGAIIAEGPGLAGTAHPDLLTDDIGLAVKDADVILIVVPAIHHASIAANIASYISEGQLIILNPGATGGALEFRKILRENGAPEVTIGETSSMLFTCRSERPGQVTVNAITGAMDFACLPAAKAGWALEQIGSVLPQYVAVENVLHTSLTNIEAVLHPLPTLLNAARCESGTPFQYYLEGITPSVGSLAEKVDAERIAIAKAFDLNVPSVCEWHKSSYGQSPATIYEAVQGNPALRGIAGPISLNTVHFFEDVSTGLVPLSELGRAVNVPTPLIDAVLDLISSLIDTDFRKEGRTLEKLGLSGLTAAGIRSAVE

SEQ ID NO: 287 - DNA, 1077 bp, Artificial Sequence
  Engineered variant of opine dehydrogenase CENDH
atgatcgagtcaaaaacatacgccgttttgggattaggaaacgggggtcacgcatttgccgcctatttagcattgaagggccagcgtgtactggcttgggacatcgatgctcagagaatcaaagagattcaggaccgtggagccatcatagcggaaggaccaggacttgctgggactgctcacccggatcttctgacctcagatataggtttggcggttaaagacgctgatgtgatactgattgtagtgccggccatccaccacgcttccattgcagcaaatatcgccagttacatttccgagggtcagttgattatccttaaccctggggcaacgggtggagcgctggaattccggaaaatcctgcgtgaaaatggtgcgccggaggtaacgatcggggaaacctcaagtatgctctttacatgccgctccgagagaccaggacaggttacggtaaatgcgataacacgtgccatgaactttgcatgtctcccagcggcaaaagctggatgggccctggaacagatagggtcggttcttcctcaatacgtggctaaagaaaacgtgttgcatacttcgctgactaatatcgaagctgtattgcacccgctgccaacactgttaaacgctgctcgttgtgagtctggtaccccattcgattattatctggaggggattacgccatcagtcgggagtcttgcggagaaagtggacgctgaacgcatagcaatcgcaaaggctttcgatttaaacgttccgtcggtctgcgaatggcataagagcagttacggccagtcaccggccacaatttatgaagcggtgcagggtaatcctgctctgcgcggcattgcgggacctaccaaccttaacacggtgcacttcttcgaggatgtaagcaccggactggtaccgttatccgaactgggtcgggcagtgaatgtgcctaccccacttatcgatgctgttcttgacttgatcagttcgctgatagacacggatttcagaaaggaaggtcgtaccttggaaaaattaggtctgagcggacttaccgccgcgggcataagaagtgctgttgag

SEQ ID NO: 288 - protein, 359 aa, Artificial Sequence
  Engineered variant of opine dehydrogenase CENDH
MIESKTYAVLGLGNGGHAFAAYLALKGQRVLAWDIDAQRIKEIQDRGAIIAEGPGLAGTAHPDLLTSDIGLAVKDADVILIVVPAIHHASIAANIASYISEGQLIILNPGATGGALEFRKILRENGAPEVTIGETSSMLFTCRSERPGQVTVNAITRAMNFACLPAAKAGWALEQIGSVLPQYVAKENVLHTSLTNIEAVLHPLPTLLNAARCESGTPFDYYLEGITPSVGSLAEKVDAERIAIAKAFDLNVPSVCEWHKSSYGQSPATIYEAVQGNPALRGIAGPTNLNTVHFFEDVSTGLVPLSELGRAVNVPTPLIDAVLDLISSLIDTDFRKEGRTLEKLGLSGLTAAGIRSAVE

SEQ ID NO: 289 - DNA, 1077 bp, Artificial Sequence
  Engineered variant of opine dehydrogenase CENDH
atgatcgagtcaaaaacatacgccgttttgggattaggaaacgggggtcacgcatttgccgcctatttagcattgaagggccagcgtgtactggcttgggacatcgatgctcagagaatcaaagagattcaggaccgtggagccatcatagcggaaggaccaggacttgctgggactgctcacccggatcttctgaccgatgatataggtttggcggttaaagacgctgatgtgatactgattgtagtgccggccatccaccacgcttccattgcagcaaatatcgccagttacatttccgagggtcagttgattatccttaaccctggggcaacgggtggagcgctggaattccggaaaatcctgcgtgaaaatggtgcgccggaggtaacgatcggggaaacctcaagtatgctctttacatgccgctccgagagaccaggacaggttacggtaaatgcgataacacgtgccatggactttgcatgtctcccagcggcaaaagctggatgggccctggaacagatagggtcggttcttcctcaatacgtggctcgtgaaaacgtgttgcatacttcgctgactaatatcgaagctgtattgcacccgctgccaacactgttaaacgctgctcgttgtgagtctggtaccccattccaatattatctggaggggattacgccatcagtcgggagtcttgcggagaaagtggacgctgaacgcatagcaatcgcaaaggctttcgatttaaacgttccgtcggtctgcgaatggcataaggcgagttacggccagtcaccggccacaatttatgaagcggtgcagggtaatcctgctctgcgcggcattgcgggacctaccagccttaacacggtgcacttcttcgaggatgtaagcaccggactggtaccgttatccgaactgggtcgggcagtgaatgtgcctaccccacttatcgatgctgttcttgacttgatcagttcgctgatagacacggatttcagaaaggaaggtcgtaccttggaaaaattaggtctgagcggacttaccgccgcgggcataagaagtgctgttgag

SEQ ID NO: 290 - protein, 359 aa, Artificial Sequence
  Engineered variant of opine dehydrogenase CENDH
MIESKTYAVLGLGNGGHAFAAYLALKGQRVLAWDIDAQRIKEIQDRGAIIAEGPGLAGTAHPDLLTDDIGLAVKDADVILIVVPAIHHASIAANIASYISEGQLIILNPGATGGALEFRKILRENGAPEVTIGETSSMLFTCRSERPGQVTVNAITRAMDFACLPAAKAGWALEQIGSVLPQYVARENVLHTSLTNIEAVLHPLPTLLNAARCESGTPFQYYLEGITPSVGSLAEKVDAERIAIAKAFDLNVPSVCEWHKASYGQSPATIYEAVQGNPALRGIAGPTSLNTVHFFEDVSTGLVPLSELGRAVNVPTPLIDAVLDLISSLIDTDFRKEGRTLEKLGLSGLTAAGIRSAVE

SEQ ID NO: 291 - DNA, 1077 bp, Artificial Sequence
  Engineered variant of opine dehydrogenase CENDH
atgatcgagtcaaaaacatacgccgttttgggattaggaaacgggggtcacgcatttgccgcctatttagcattgaagggccagcgtgtactggcttgggacatcgatgctcagagaatcaaagagattcaggaccgtggagccatcatagcggaaggaccaggacttgctgggactgctcacccggatcttctgacctcagatataggtttggcggttaaagacgctgatgtgatactgattgtagtgccggccatccaccacgcttccattgcagcaaatatcgccagttacatttccgagggtcagttgattatccttaaccctggggcaacgggtggagcgctggaattccggaaaatcctgcgtgaaaatggtgcgccggaggtaacgatcggggaaacctcaagtatgctctttacatgccgctccgagagaccaggacaggttacggtaaatgcgataacacgtgccatgaactttgcatgtctcccagcggcaaaagctggatgggccctggaacagatagggtcggttcttcctcaatacgtggctaaagaaaacgtgttgcatacttcgctgactaatatcgaagctgtattgcacccgctgccaacactgttaaacgctgctcgttgtgagtctggtaccccattccaatattatctggaggggattacgccatcagtcgggagtcttgcggagaaagtggacgctgaacgcatagcaatcgcaaaggctttcgatttaaacgttccgtcggtctgcgaatggcataaggaaagttacggccagtcaccggccacaatttatgaagcggtgcagggtaatcctgctctgcgcggcattgcgggacctaccagccttaacacggtgcacttcttcgaggatgtaagcaccggactggtaccgttatccgaactgggtcgggcagtgaatgtgcctaccccacttatcgatgctgttcttgacttgatcagttcgctgatagacacggatttcagaaaggaaggtcgtaccttggaaaaattaggtctgagcggacttaccgccgcgggcataagaagtgctgttgag

SEQ ID NO: 292 - protein, 359 aa, Artificial Sequence
  Engineered variant of opine dehydrogenase CENDH
MIESKTYAVLGLGNGGHAFAAYLALKGQRVLAWDIDAQRIKEIQDRGAIIAEGPGLAGTAHPDLLTSDIGLAVKDADVILIVVPAIHHASIAANIASYISEGQLIILNPGATGGALEFRKILRENGAPEVTIGETSSMLFTCRSERPGQVTVNAITRAMNFACLPAAKAGWALEQIGSVLPQYVAKENVLHTSLTNIEAVLHPLPTLLNAARCESGTPFQYYLEGITPSVGSLAEKVDAERIAIAKAFDLNVPSVCEWHKESYGQSPATIYEAVQGNPALRGIAGPTSLNTVHFFEDVSTGLVPLSELGRAVNVPTPLIDAVLDLISSLIDTDFRKEGRTLEKLGLSGLTAAGIRSAVE

SEQ ID NO: 293 - DNA, 1077 bp, Artificial Sequence
  Engineered variant of opine dehydrogenase CENDH
atgatcgagtcaaaaacatacgccgttttgggattaggaaacgggggtcacgcatttgccgcctatttagcattgaagggccagcgtgtactggcttgggacatcgatgctcagagaatcaaagagattcaggaccgtggagccatcatagcggaaggaccaggacttgctgggactgctcacccggatcttctgacctcagatataggtttggcggttaaagacgctgatgtgatactgattgtagtgccggccatccaccacgcttccattgcagcaaatatcgccagttacatttccgagggtcagttgattatccttaaccctggggcaacgggtggagcgctggaattccggaaaatcctgcgtgaaaatggtgcgccggaggtaacgatcggggaaacctcaagtatgctctttacatgccgctccgagagaccaggacaggttacggtaaatgcgataacacgtgccatggactttgcatgtctcccagcggcaaaagctggatgggccctggaacagatagggtcggttcttcctcaatacaaagctgtcgaaaacgtgttgcatacttcgctgactaatatcgaagctgtattgcacccgctgccaacactgttaaacgctgctcgttgtgagtctggtaccccattccattattataccgaggggattacgccatcagtcggggcgcttgcggagaaagtggacgctgaacgcatagcaatcgcaaaggctttcgatttaaacgttccgtcggtctgcgaatggcataagagcagttacggccagtcaccggccacaatttatgaagcggtgcagggtaatcctgctctgcgcggcattctgggacctaccagccttaacacggtgcacttcttcgaggatgtaagcaccggactggtaccgttatccgaactgggtcgggcagtgaatgtgcctaccccacttatcgatgctgttcttgacttgatcagttcgctgatagacgtggatttcagaaaggaaggtcgtaccttggaaaaattaggtctgagcggacttaccgccgcggaaataagaagtgctgttgag

SEQ ID NO: 294 - protein, 359 aa, Artificial Sequence
  Engineered variant of opine dehydrogenase CENDH
MIESKTYAVLGLGNGGHAFAAYLALKGQRVLAWDIDAQRIKEIQDRGAIIAEGPGLAGTAHPDLLTSDIGLAVKDADVILIVVPAIHHASIAANIASYISEGQLIILNPGATGGALEFRKILRENGAPEVTIGETSSMLFTCRSERPGQVTVNAITRAMDFACLPAAKAGWALEQIGSVLPQYKAVENVLHTSLTNIEAVLHPLPTLLNAARCESGTPFHYYTEGITPSVGALAEKVDAERIAIAKAFDLNVPSVCEWHKSSYGQSPATIYEAVQGNPALRGILGPTSLNTVHFFEDVSTGLVPLSELGRAVNVPTPLIDAVLDLISSLIDVDFRKEGRTLEKLGLSGLTAAEIRSAVE

SEQ ID NO: 295 - DNA, 1077 bp, Artificial Sequence
  Engineered variant of opine dehydrogenase CENDH
atgatcgagtcaaaaacatacgccgttttgggattaggaaacgggggtcacgcatttgccgcctatttagcattgaagggccagcgtgtactggcttgggacatcgatgctcagagaatcaaagagattcaggaccgtggagccatcatagcggaaggaccaggacttgctgggactgctcacccggatcttctgacctcagatataggtttggcggttaaagacgctgatgtgatactgattgtagtgccggccatccaccacgcttccattgcagcaaatatcgccccgtacatttccgagggtcagttgattatccttaaccctggggcaacgggtggagcgctggaattccggaaaatcctgcgtgaaaatggtgcgccggaggtaacgatcggggaaacctcaagtatgctctttacatgccgctccgagagaccaggacaggttacggtaaatgcgataacacgtaaaatggactttgcatgtctcccagcggcaaaagctggatgggccctggaacagatagggtcggttcttcctcaataccgtgctgtcgaaaacgtgttgcatacttcgctgactaatatcgaagctgtattgcacccgctgccaacactgttaaacgctgctcgttgtgagtctggtaccccattccattattataccgaggggattacgccatcagtcggggcgcttgcggagaaagtggacgctgaacgcatagcaatcgcaaaggctttcgatttaaacgttccgtcggtctgcgaatggcataagaaaagttacggccagtcaccggccacaatttatgaagcggtgcagggtaatcctgctctgcgcggcattctgggacctaccaaccttaacacggtgcacttcttcgaggatgtaagcaccggactggtaccgttatccgaactgggtcgggcagtgaatgtgcctaccccacttatcgatgctgttcttctgttgatcagttcgctgatagacgtggatttcagaaaggaaggtcgtaccttggaaaaattaggtctgagcggacttaccgccgcggaaataagaagtgctgttgag

SEQ ID NO: 296 - protein, 359 aa, Artificial Sequence
  Engineered variant of opine dehydrogenase CENDH
MIESKTYAVLGLGNGGHAFAAYLALKGQRVLAWDIDAQRIKEIQDRGAIIAEGPGLAGTAHPDLLTSDIGLAVKDADVILIVVPAIHHASIAANIAPYISEGQLIILNPGATGGALEFRKILRENGAPEVTIGETSSMLFTCRSERPGQVTVNAITRKMDFACLPAAKAGWALEQIGSVLPQYRAVENVLHTSLTNIEAVLHPLPTLLNAARCESGTPFHYYTEGITPSVGALAEKVDAERIAIAKAFDLNVPSVCEWHKKSYGQSPATIYEAVQGNPALRGILGPTNLNTVHFFEDVSTGLVPLSELGRAVNVPTPLIDAVLLLISSLIDVDFRKEGRTLEKLGLSGLTAAEIRSAVE

SEQ ID NO: 297 - DNA, 1077 bp, Artificial Sequence
  Engineered variant of opine dehydrogenase CENDH
atgatcgagtcaaaaacatacgccgttttgggattaggaaacgggggtcacgcatttgccgcctatttagcattgaagggccagcgtgtactggcttgggacatcgatgctcagagaatcaaagagattcaggaccgtggagccatcatagcggaaggaccaggacttgctgggactgctcacccggatcttctgacctcagatataggtttggcggttaaagacgctgatgtgatactgattgtagtgccggccatccaccacgcttccattgcagcaaatatcgccagttacatttccgagggtcagttgattatccttaaccctggggcaacgggtggagcgctggaattccggaaaatcctgcgtgaaaatggtgcgccggaggtaacgatcggggaaacctcaagtatgctctttacatgccgctccgagagaccaggacaggttacggtaaatgcgataacacgtaaaatggactttgcatgtctcccagcggcaaaagctggatgggccctggaacagatagggtcggttcttcctcaatacaaagctgtcgaaaacgtgttgcatacttcgctgactaatatcgaagctgtattgcacccgctgccaacactgttaaacgctgctcgttgtgagtctggtaccccattcgattattataccgaggggattacgccatcagtcgggcgtcttgcggagaaagtggacgctgaacgcatagcaatcgcaaaggctttcgatttaaacgttccgtcggtctgcgaatggcataagcgtagttacggccagtcaccggccacaatttatgaagcggtgcagggtaatcctgctctgcgcggcattatgggacctaccagccttaacacggtgcacttcttcgaggatgtaagcaccggactggtaccgttatccgaactgggtcgggcagtgaatgtgcctaccccacttatcgatgctgttcttgacttgatcagttcgctgatagacacggatttcagaaaggaaggtcgtaccttggaaaaattaggtctgagcggacttaccgccgcgggcataagaagtgctgttgag

SEQ ID NO: 298 - protein, 359 aa, Artificial Sequence
  Engineered variant of opine dehydrogenase CENDH
MIESKTYAVLGLGNGGHAFAAYLALKGQRVLAWDIDAQRIKEIQDRGAIIAEGPGLAGTAHPDLLTSDIGLAVKDADVILIVVPAIHHASIAANIASYISEGQLIILNPGATGGALEFRKILRENGAPEVTIGETSSMLFTCRSERPGQVTVNAITRKMDFACLPAAKAGWALEQIGSVLPQYKAVENVLHTSLTNIEAVLHPLPTLLNAARCESGTPFDYYTEGITPSVGRLAEKVDAERIAIAKAFDLNVPSVCEWHKRSYGQSPATIYEAVQGNPALRGIMGPTSLNTVHFFEDVSTGLVPLSELGRAVNVPTPLIDAVLDLISSLIDTDFRKEGRTLEKLGLSGLTAAGIRSAVE

SEQ ID NO: 299 - DNA, 1077 bp, Artificial Sequence
  Engineered variant of opine dehydrogenase CENDH
atgatcgagtcaaaaacatacgccgttttgggattaggaaacgggggtcacgcatttgccgcctatttagcattgaagggccagcgtgtactggcttgggacatcgatgctcagagaatcaaagagattcaggaccgtggagccatcatagcggaaggaccaggacttgctgggactgctcacccggatcttctgacctcagatataggtttggcggttaaagacgctgatgtgatactgattgtagtgccggccatccaccacgcttccattgcagcaaatatcgccagttacatttccgagggtcagttgattatccttaaccctggggcaacgggtggagcgctggaattccggaaaatcctgcgtgaaaatggtgcgccggaggtaacgatcggggaaacctcaagtatgctctttacatgccgctccgagagaccaggacaggttacggtaaatgcgataacaggcgccatggactttgcatgtctcccagcggcaaaagctggatgggccctggaacagatagggtcggttcttcctcaataccgtgctgtcgaaaacgtgttgcatacttcgctgactaatatcgaagctgtattgcacccgctgccaacactgttaaacgctgctcgttgtgagtctggtaccccattcgattattataccgaggggattacgccatcagtcgggagtcttgcggagaaagtggacgctgaacgcatagcaatcgcaaaggctttcgatttaaacgttccgtcggtctgcgaatggcataagagcagttacggccagtcaccggccacaatttatgaagcggtgcagggtaatcctgctctgcgcggcattatgggacctaccagccttaacacggtgcacttcttcgaggatgtaagcaccggactggtaccgttatccgaactgggtcgggcagtgaatgtgcctaccccacttatcgatgctgttcttctgttgatcagttcgctgatagacacggatttcagaaaggaaggtcgtaccttggaaaaattaggtctgagcggacttaccgccgcggaaataagaagtgctgttgag

SEQ ID NO: 300 - protein, 359 aa, Artificial Sequence
  Engineered variant of opine dehydrogenase CENDH
MIESKTYAVLGLGNGGHAFAAYLALKGQRVLAWDIDAQRIKEIQDRGAIIAEGPGLAGTAHPDLLTSDIGLAVKDADVILIVVPAIHHASIAANIASYISEGQLIILNPGATGGALEFRKILRENGAPEVTIGETSSMLFTCRSERPGQVTVNAITGAMDFACLPAAKAGWALEQIGSVLPQYRAVENVLHTSLTNIEAVLHPLPTLLNAARCESGTPFDYYTEGITPSVGSLAEKVDAERIAIAKAFDLNVPSVCEWHKSSYGQSPATIYEAVQGNPALRGIMGPTSLNTVHFFEDVSTGLVPLSELGRAVNVPTPLIDAVLLLISSLIDTDFRKEGRTLEKLGLSGLTAAEIRSAVE

SEQ ID NO: 301 - DNA, 1077 bp, Artificial Sequence
  Engineered variant of opine dehydrogenase CENDH
atgatcgagtcaaaaacatacgccgttttgggattaggaaacgggggtcacgcatttgccgcctatttagcattgaagggccagcgtgtactggcttgggacatcgatgctcagagaatcaaagagattcaggaccgtggagccatcatagcggaaggaccaggacttgctgggactgctcacccggatcttctgacctcagatataggtttggcggttaaagacgctgatgtgatactgattgtagtgccggccatccaccacgcttccattgcagcaaatatcgccagttacatttccgagggtcagttgattatccttaaccctggggcaacgggtggagcgctggaattccggaaaatcctgcgtgaaaatggtgcgccggaggtaacgatcggggaaacctcaagtatgctctttacatgccgctccgagagaccaggacaggttacggtaaatgcgataacaggcgccatggactttgcatgtctcccagcggcaaaagctggatgggccctggaacagatagggtcggttcttcctcaataccaggctgtcgaaaacgtgttgcatacttcgctgactaatatcgaagctgtattgcacccgctgccaacactgttaaacgctgctcgttgtgagtctggtaccccattccattattataccgaggggattacgccatcagtcgggcgtcttgcggagaaagtggacgctgaacgcatagcaatcgcaaaggctttcgatttaaacgttccgtcggtctgcgaatggcataagcgtagttacggccagtcaccggccacaatttatgaagcggtgcagggtaatcctgctctgcgcggcattatgggacctaccagccttaacacggtgcacttcttcgaggatgtaagcaccggactggtaccgttatccgaactgggtcgggcagtgaatgtgcctaccccacttatcgatgctgttcttgacttgatcagttcgctgatagacgtggatttcagaaaggaaggtcgtaccttggaaaaattaggtctgagcggacttaccgccgcggaaataagaagtgctgttgag

SEQ ID NO: 302 - protein, 359 aa, Artificial Sequence
  Engineered variant of opine dehydrogenase CENDH
MIESKTYAVLGLGNGGHAFAAYLALKGQRVLAWDIDAQRIKEIQDRGAIIAEGPGLAGTAHPDLLTSDIGLAVKDADVILIVVPAIHHASIAANIASYISEGQLIILNPGATGGALEFRKILRENGAPEVTIGETSSMLFTCRSERPGQVTVNAITGAMDFACLPAAKAGWALEQIGSVLPQYQAVENVLHTSLTNIEAVLHPLPTLLNAARCESGTPFHYYTEGITPSVGRLAEKVDAERIAIAKAFDLNVPSVCEWHKRSYGQSPATIYEAVQGNPALRGIMGPTSLNTVHFFEDVSTGLVPLSELGRAVNVPTPLIDAVLDLISSLIDVDFRKEGRTLEKLGLSGLTAAEIRSAVE

SEQ ID NO: 303 - DNA, 1077 bp, Artificial Sequence
  Engineered variant of opine dehydrogenase CENDH
atgatcgagtcaaaaacatacgccgttttgggattaggaaacgggggtcacgcatttgccgcctatttagcattgaagggccagcgtgtactggcttgggacatcgatgctcagagaatcaaagagattcaggaccgtggagccatcatagcggaaggaccaggacttgctgggactgctcacccggatcttctgacctcagatataggtttggcggttaaagacgctgatgtgatactgattgtagtgccggccatccaccacgcttccattgcagcaaatatcgccagttacatttccgagggtcagttgattatccttaaccctggggcaacgggtggagcgctggaattccggaaaatcctgcgtgaaaatggtgcgccggaggtaacgatcggggaaacctcaagtatgctctttacatgccgctccgagagaccaggacaggttacggtaaatgcgataacacgtgccatggactttgcatgtctcccagcggcaaaagctggatgggccctggaacagatagggtcggttcttcctcaatacaaagctgtcgaaaacgtgttgcatacttcgctgactaatatcgaagctgtattgcacccgctgccaacactgttaaacgctgctcgttgtgagtctggtaccccattcgattattataccgaggggattacgccatcagtcggggcgcttgcggagaaagtggacgctgaacgcatagcaatcgcaaaggctttcgatttaaacgttccgtcggtctgcgaatggcataagcgtagttacggccagtcaccggccacaatttatgaagcggtgcagggtaatcctgctctgcgcggcattctgggacctaccaaccttaacacggtgcacttcttcgaggatgtaagcaccggactggtaccgttatccgaactgggtcgggcagtgaatgtgcctaccccacttatcgatgctgttcttaccttgatcagttcgctgatagacacggatttcagaaaggaaggtcgtaccttggaaaaattaggtctgagcggacttaccgccgcggaaataagaagtgctgttgag

SEQ ID NO: 304 - protein, 359 aa, Artificial Sequence
  Engineered variant of opine dehydrogenase CENDH
MIESKTYAVLGLGNGGHAFAAYLALKGQRVLAWDIDAQRIKEIQDRGAIIAEGPGLAGTAHPDLLTSDIGLAVKDADVILIVVPAIHHASIAANIASYISEGQLIILNPGATGGALEFRKILRENGAPEVTIGETSSMLFTCRSERPGQVTVNAITRAMDFACLPAAKAGWALEQIGSVLPQYKAVENVLHTSLTNIEAVLHPLPTLLNAARCESGTPFDYYTEGITPSVGALAEKVDAERIAIAKAFDLNVPSVCEWHKRSYGQSPATIYEAVQGNPALRGILGPTNLNTVHFFEDVSTGLVPLSELGRAVNVPTPLIDAVLTLISSLIDTDFRKEGRTLEKLGLSGLTAAEIRSAVE

SEQ ID NO: 305 - DNA, 1077 bp, Artificial Sequence
  Engineered variant of opine dehydrogenase CENDH
atgatcgagtcaaaaacatacgccgttttgggattaggaaacgggggtcacgcatttgccgcctatttagcattgaagggccagcgtgtactggcttgggacatcgatgctcagagaatcaaagagattcaggaccgtggagccatcatagcggaaggaccaggacttgctgggactgctcacccggatcttctgacctcagatataggtttggcggttaaagacgctgatgtgatactgattgtagtgccggccatccaccacgcttccattgcagcaaatatcgccagttacatttccgagggtcagttgattatccttaaccctggggcaacgggtggagcgctggaattccggaaaatcctgcgtgaaaatggtgcgccggaggtaacgatcggggaaacctcaagtatgctctttacatgccgctccgagagaccaggacaggttacggtaaatgcgataacacgtgccatggactttgcatgtctcccagcggcaaaagctggatgggccctggaacagatagggtcggttcttcctcaataccaggctgtcgaaaacgtgttgcatacttcgctgactaatatcgaagctgtattgcacccgctgccaacactgttaaacgctgctcgttgtgagtctggtaccccattccattattataccgaggggattacgccatcagtcgggcgtcttgcggagaaagtggacgctgaacgcatagcaatcgcaaaggctttcgatttaaacgttccgtcggtctgcgaatggcataagattagttacggccagtcaccggccacaatttatgaagcggtgcagggtaatcctgctctgcgcggcattctgggacctaccagccttaacacggtgcacttcttcgaggatgtaagcaccggactggtaccgttatccgaactgggtcgggcagtgaatgtgcctaccccacttatcgatgctgttcttgacttgatcagttcgctgatagacacggatttcagaaaggaaggtcgtaccttggaaaaattaggtctgagcggacttaccgccgcgggcataagaagtgctgttgag

SEQ ID NO: 306 - protein, 359 aa, Artificial Sequence
  Engineered variant of opine dehydrogenase CENDH
MIESKTYAVLGLGNGGHAFAAYLALKGQRVLAWDIDAQRIKEIQDRGAIIAEGPGLAGTAHPDLLTSDIGLAVKDADVILIVVPAIHHASIAANIASYISEGQLIILNPGATGGALEFRKILRENGAPEVTIGETSSMLFTCRSERPGQVTVNAITRAMDFACLPAAKAGWALEQIGSVLPQYQAVENVLHTSLTNIEAVLHPLPTLLNAARCESGTPFHYYTEGITPSVGRLAEKVDAERIAIAKAFDLNVPSVCEWHKISYGQSPATIYEAVQGNPALRGILGPTSLNTVHFFEDVSTGLVPLSELGRAVNVPTPLIDAVLDLISSLIDTDFRKEGRTLEKLGLSGLTAAGIRSAVE

SEQ ID NO: 307 - DNA, 1077 bp, Artificial Sequence
  Engineered variant of opine dehydrogenase CENDH
atgatcgagtcaaaaacatacgccgttttgggattaggaaacgggggtcacgcatttgccgcctatttagcattgaagggccagcgtgtactggcttgggacatcgatgctcagagaatcaaagagattcaggaccgtggagccatcatagcggaaggaccaggacttgctgggactgctcacccggatcttctgacctcagatataggtttggcggttaaagacgctgatgtgatactgattgtagtgccggccatccaccacgcttccattgcagcaaatatcgccagttacatttccgagggtcagttgattatccttaaccctggggcaacgggtggagcgctggaattccggaaaatcctgcgtgaaaatggtgcgccggaggtaacgatcggggaaacctcaagtatgctctttacatgccgctccgagagaccaggacaggttacggtaaatgcgataacacgtaaaatggactttgcatgtctcccagcggcaaaagctggatgggccctggaacagatagggtcggttcttcctcaataccaggctgtcgaaaacgtgttgcatacttcgctgactaatatcgaagctgtattgcacccgctgccaacactgttaaacgctgctcgttgtgagtctggtaccccattcgattattataccgaggggattacgccatcagtcgggcgtcttgcggagaaagtggacgctgaacgcatagcaatcgcaaaggctttcgatttaaacgttccgtcggtctgcgaatggcataagggcagttacggccagtcaccggccacaatttatgaagcggtgcagggtaatcctgctctgcgcggcattgcgggacctaccagccttaacacggtgcacttcttcgaggatgtaagcaccggactggtaccgttatccgaactgggtcgggcagtgaatgtgcctaccccacttatcgatgctgttcttctgttgatcagttcgctgatagacgtggatttcagaaaggaaggtcgtaccttggaaaaattaggtctgagcggacttaccgccgcggaaataagaagtgctgttgag

SEQ ID NO: 308 - protein, 359 aa, Artificial Sequence
  Engineered variant of opine dehydrogenase CENDH
MIESKTYAVLGLGNGGHAFAAYLALKGQRVLAWDIDAQRIKEIQDRGAIIAEGPGLAGTAHPDLLTSDIGLAVKDADVILIVVPAIHHASIAANIASYISEGQLIILNPGATGGALEFRKILRENGAPEVTIGETSSMLFTCRSERPGQVTVNAITRKMDFACLPAAKAGWALEQIGSVLPQYQAVENVLHTSLTNIEAVLHPLPTLLNAARCESGTPFDYYTEGITPSVGRLAEKVDAERIAIAKAFDLNVPSVCEWHKGSYGQSPATIYEAVQGNPALRGIAGPTSLNTVHFFEDVSTGLVPLSELGRAVNVPTPLIDAVLLLISSLIDVDFRKEGRTLEKLGLSGLTAAEIRSAVE

SEQ ID NO: 309 - DNA, 1077 bp, Artificial Sequence
  Engineered variant of opine dehydrogenase CENDH
atgatcgagtcaaaaacatacgccgttttgggattaggaaacgggggtcacgcatttgccgcctatttagcattgaagggccagcgtgtactggcttgggacatcgatgctcagagaatcaaagagattcaggaccgtggagccatcatagcggaaggaccaggacttgctgggactgctcacccggatcttctgacctcagatataggtttggcggttaaagacgctgatgtgatactgattgtagtgccggccatccaccacgcttccattgcagcaaatatcgccagttacatttccgagggtcagttgattatccttaaccctggggcaacgggtggagcgctggaattccggaaaatcctgcgtgaaaatggtgcgccggaggtaacgatcggggaaacctcaagtatgctctttacatgccgctccgagagaccaggacaggttacggtaaatgcgataacaggcgccatggactttgcatgtctcccagcggcaaaagctggatgggccctggaacagatagggtcggttcttcctcaatacaaagctgtcgaaaacgtgttgcatacttcgctgactaatatcgaagctgtattgcacccgctgccaacactgttaaacgctgctcgttgtgagtctggtaccccattcgattattataccgaggggattacgccatcagtcgggcgtcttgcggagaaagtggacgctgaacgcatagcaatcgcaaaggctttcgatttaaacgttccgtcggtctgcgaatggcataagagcagttacggccagtcaccggccacaatttatgaagcggtgcagggtaatcctgctctgcgcggcattatgggacctaccagccttaacacggtgcacttcttcgaggatgtaagcaccggactggtaccgttatccgaactgggtcgggcagtgaatgtgcctaccccacttatcgatgctgttcttgacttgatcagttcgctgatagacacggatttcagaaaggaaggtcgtaccttggaaaaattaggtctgagcggacttaccgccgcggaaataagaagtgctgttgag

SEQ ID NO: 310 - protein, 359 aa, Artificial Sequence
  Engineered variant of opine dehydrogenase CENDH
MIESKTYAVLGLGNGGHAFAAYLALKGQRVLAWDIDAQRIKEIQDRGAIIAEGPGLAGTAHPDLLTSDIGLAVKDADVILIVVPAIHHASIAANIASYISEGQLIILNPGATGGALEFRKILRENGAPEVTIGETSSMLFTCRSERPGQVTVNAITGAMDFACLPAAKAGWALEQIGSVLPQYKAVENVLHTSLTNIEAVLHPLPTLLNAARCESGTPFDYYTEGITPSVGRLAEKVDAERIAIAKAFDLNVPSVCEWHKSSYGQSPATIYEAVQGNPALRGIMGPTSLNTVHFFEDVSTGLVPLSELGRAVNVPTPLIDAVLDLISSLIDTDFRKEGRTLEKLGLSGLTAAEIRSAVE

SEQ ID NO: 311 - DNA, 1077 bp, Artificial Sequence
  Engineered variant of opine dehydrogenase CENDH
atgatcgagtcaaaaacatacgccgttttgggattaggaaacgggggtcacgcatttgccgcctatttagcattgaagggccagcgtgtactggcttgggacatcgatgctcagagaatcaaagagattcaggaccgtggagccatcatagcggaaggaccaggacttgctgggactgctcacccggatcttctgacctcagatataggtttggcggttaaagacgctgatgtgatactgattgtagtgccggccatccaccacgcttccattgcagcaaatatcgccagttacatttccgagggtcagttgattatccttaaccctggggcaacgggtggagcgctggaattccggaaaatcctgcgtgaaaatggtgcgccggaggtaacgatcggggaaacctcaagtatgctctttacatgccgctccgagagaccaggacaggttacggtaaatgcgataacacgtaaaatggactttgcatgtctcccagcggcaaaagctggatgggccctggaacagatagggtcggttcttcctcaataccaggctgtcgaaaacgtgttgcatacttcgctgactaatatcgaagctgtattgcacccgctgccaacactgttaaacgctgctcgttgtgagtctggtaccccattccattattataccgaggggattacgccatcagtcgggagtcttgcggagaaagtggacgctgaacgcatagcaatcgcaaaggctttcgatttaaacgttccgtcggtctgcgaatggcataagcgtagttacggccagtcaccggccacaatttatgaagcggtgcagggtaatcctgctctgcgcggcattatgggacctaccagccttaacacggtgcacttcttcgaggatgtaagcaccggactggtaccgttatccgaactgggtcgggcagtgaatgtgcctaccccacttatcgatgctgttcttctgttgatcagttcgctgatagacgtggatttcagaaaggaaggtcgtaccttggaaaaattaggtctgagcggacttaccgccgcgggcataagaagtgctgttgag

SEQ ID NO: 312 - protein, 359 aa, Artificial Sequence
  Engineered variant of opine dehydrogenase CENDH
MIESKTYAVLGLGNGGHAFAAYLALKGQRVLAWDIDAQRIKEIQDRGAIIAEGPGLAGTAHPDLLTSDIGLAVKDADVILIVVPAIHHASIAANIASYISEGQLIILNPGATGGALEFRKILRENGAPEVTIGETSSMLFTCRSERPGQVTVNAITRKMDFACLPAAKAGWALEQIGSVLPQYQAVENVLHTSLTNIEAVLHPLPTLLNAARCESGTPFHYYTEGITPSVGSLAEKVDAERIAIAKAFDLNVPSVCEWHKRSYGQSPATIYEAVQGNPALRGIMGPTSLNTVHFFEDVSTGLVPLSELGRAVNVPTPLIDAVLLLISSLIDVDFRKEGRTLEKLGLSGLTAAGIRSAVE

SEQ ID NO: 313 - DNA, 1077 bp, Artificial Sequence
  Engineered variant of opine dehydrogenase CENDH
atgatcgagtcaaaaacatacgccgttttgggattaggaaacgggggtcacgcatttgccgcctatttagcattgaagggccagcgtgtactggcttgggacatcgatgctcagagaatcaaagagattcaggaccgtggagccatcatagcggaaggaccaggacttgctgggactgctcacccggatcttctgacctcagatataggtttggcggttaaagacgctgatgtgatactgattgtagtgccggccatccaccacgcttccattgcagcaaatatcgccagttacatttccgagggtcagttgattatccttaaccctggggcaacgggtggagcgctggaattccggaaaatcctgcgtgaaaatggtgcgccggaggtaacgatcggggaaacctcaagtatgctctttacatgccgctccgagagaccaggacaggttacggtaaatgcgataacaggcgccatggactttgcatgtctcccagcggcaaaagctggatgggccctggaacagatagggtcggttcttcctcaatacaaagctgtcgaaaacgtgttgcatacttcgctgactaatatcgaagctgtattgcacccgctgccaacactgttaaacgctgctcgttgtgagtctggtaccccattccattattataccgaggggattacgccatcagtcgggcgtcttgcggagaaagtggacgctgaacgcatagcaatcgcaaaggctttcgatttaaacgttccgtcggtctgcgaatggcataagattagttacggccagtcaccggccacaatttatgaagcggtgcagggtaatcctgctctgcgcggcattatgggacctaccagccttaacacggtgcacttcttcgaggatgtaagcaccggactggtaccgttatccgaactgggtcgggcagtgaatgtgcctaccccacttatcgatgctgttcttctgttgatcagttcgctgatagacacggatttcagaaaggaaggtcgtaccttggaaaaattaggtctgagcggacttaccgccgcggaaataagaagtgctgttgag

SEQ ID NO: 314 - protein, 359 aa, Artificial Sequence
  Engineered variant of opine dehydrogenase CENDH
MIESKTYAVLGLGNGGHAFAAYLALKGQRVLAWDIDAQRIKEIQDRGAIIAEGPGLAGTAHPDLLTSDIGLAVKDADVILIVVPAIHHASIAANIASYISEGQLIILNPGATGGALEFRKILRENGAPEVTIGETSSMLFTCRSERPGQVTVNAITGAMDFACLPAAKAGWALEQIGSVLPQYKAVENVLHTSLTNIEAVLHPLPTLLNAARCESGTPFHYYTEGITPSVGRLAEKVDAERIAIAKAFDLNVPSVCEWHKISYGQSPATIYEAVQGNPALRGIMGPTSLNTVHFFEDVSTGLVPLSELGRAVNVPTPLIDAVLLLISSLIDTDFRKEGRTLEKLGLSGLTAAEIRSAVE

SEQ ID NO: 315 - DNA, 1077 bp, Artificial Sequence
  Engineered variant of opine dehydrogenase CENDH
atgatcgagtcaaaaacatacgccgttttgggattaggaaacgggggtcacgcatttgccgcctatttagcattgaagggccagcgtgtactggcttgggacatcgatgctcagagaatcaaagagattcaggaccgtggagccatcatagcggaaggaccaggacttgctgggactgctcacccggatcttctgacctcagatataggtttggcggttaaagacgctgatgtgatactgattgtagtgccggccatccaccacgcttccattgcagcaaatatcgccagttacatttccgagggtcagttgattatccttaaccctggggcaacgggtggagcgctggaattccggaaaatcctgcgtgaaaatggtgcgccggaggtaacgatcggggaaacctcaagtatgctctttacatgccgctccgagagaccaggacaggttacggtaaatgcgataacacgtgccatggactttgcatgtctcccagcggcaaaagctggatgggccctggaacagatagggtcggttcttcctcaataccaggctgtcgaaaacgtgttgcatacttcgctgactaatatcgaagctgtattgcacccgctgccaacactgttaaacgctgctcgttgtgagtctggtaccccattccaatattataccgaggggattacgccatcagtcgggcgtcttgcggagaaagtggacgctgaacgcatagcaatcgcaaaggctttcgatttaaacgttccgtcggtctgcgaatggcataagagcagttacggccagtcaccggccacaatttatgaagcggtgcagggtaatcctgctctgcgcggcattgcgggacctaccaaccttaacacggtgcacttcttcgaggatgtaagcaccggactggtaccgttatccgaactgggtcgggcagtgaatgtgcctaccccacttatcgatgctgttcttctgttgatcagttcgctgatagacgtggatttcagaaaggaaggtcgtaccttggaaaaattaggtctgagcggacttaccgccgcggaaataagaagtgctgttgag

SEQ ID NO: 316 - protein, 359 aa, Artificial Sequence
  Engineered variant of opine dehydrogenase CENDH
MIESKTYAVLGLGNGGHAFAAYLALKGQRVLAWDIDAQRIKEIQDRGAIIAEGPGLAGTAHPDLLTSDIGLAVKDADVILIVVPAIHHASIAANIASYISEGQLIILNPGATGGALEFRKILRENGAPEVTIGETSSMLFTCRSERPGQVTVNAITRAMDFACLPAAKAGWALEQIGSVLPQYQAVENVLHTSLTNIEAVLHPLPTLLNAARCESGTPFQYYTEGITPSVGRLAEKVDAERIAIAKAFDLNVPSVCEWHKSSYGQSPATIYEAVQGNPALRGIAGPTNLNTVHFFEDVSTGLVPLSELGRAVNVPTPLIDAVLLLISSLIDVDFRKEGRTLEKLGLSGLTAAEIRSAVE

SEQ ID NO: 317 - DNA, 1077 bp, Artificial Sequence
  Engineered variant of opine dehydrogenase CENDH
atgatcgagtcaaaaacatacgccgttttgggattaggaaacgggggtcacgcatttgccgcctatttagcattgaagggccagcgtgtactggcttgggacatcgatgctcagagaatcaaagagattcaggaccgtggagccatcatagcggaaggaccaggacttgctgggactgctcacccggatcttctgacctcagatataggtttggcggttaaagacgctgatgtgatactgattgtagtgccggccatccaccacgcttccattgcagcaaatatcgccagttacatttccgagggtcagttgattatccttaaccctggggcaacgggtggagcgctggaattccggaaaatcctgcgtgaaaatggtgcgccggaggtaacgatcggggaaacctcaagtatgctctttacatgccgctccgagagaccaggacaggttacggtaaatgcgataacacgtgccatggactttgcatgtctcccagcggcaaaagctggatgggccctggaacagatagggtcggttcttcctcaataccgtgctgtcgaaaacgtgttgcatacttcgctgactaatatcgaagctgtattgcacccgctgccaacactgttaaacgctgctcgttgtgagtctggtaccccattccaatattataccgaggggattacgccatcagtcggggcgcttgcggagaaagtggacgctgaacgcatagcaatcgcaaaggctttcgatttaaacgttccgtcggtctgcgaatggcataagagcagttacggccagtcaccggccacaatttatgaagcggtgcagggtaatcctgctctgcgcggcattatgggacctaccagccttaacacggtgcacttcttcgaggatgtaagcaccggactggtaccgttatccgaactgggtcgggcagtgaatgtgcctaccccacttatcgatgctgttcttgacttgatcagttcgctgatagacacggatttcagaaaggaaggtcgtaccttggaaaaattaggtctgagcggacttaccgccgcgggcataagaagtgctgttgag

SEQ ID NO: 318 - protein, 359 aa, Artificial Sequence
  Engineered variant of opine dehydrogenase CENDH
MIESKTYAVLGLGNGGHAFAAYLALKGQRVLAWDIDAQRIKEIQDRGAIIAEGPGLAGTAHPDLLTSDIGLAVKDADVILIVVPAIHHASIAANIASYISEGQLIILNPGATGGALEFRKILRENGAPEVTIGETSSMLFTCRSERPGQVTVNAITRAMDFACLPAAKAGWALEQIGSVLPQYRAVENVLHTSLTNIEAVLHPLPTLLNAARCESGTPFQYYTEGITPSVGALAEKVDAERIAIAKAFDLNVPSVCEWHKSSYGQSPATIYEAVQGNPALRGIMGPTSLNTVHFFEDVSTGLVPLSELGRAVNVPTPLIDAVLDLISSLIDTDFRKEGRTLEKLGLSGLTAAGIRSAVE

SEQ ID NO: 319 - DNA, 1077 bp, Artificial Sequence
  Engineered variant of opine dehydrogenase CENDH
atgatcgagtcaaaaacatacgccgttttgggattaggaaacgggggtcacgcatttgccgcctatttagcattgaagggccagcgtgtactggcttgggacatcgatgctcagagaatcaaagagattcaggaccgtggagccatcatagcggaaggaccaggacttgctgggactgctcacccggatcttctgacctcagatataggtttggcggttaaagacgctgatgtgatactgattgtagtgccggccatccaccacgcttccattgcagcaaatatcgccagttacatttccgagggtcagttgattatccttaaccctggggcaacgggtggagcgctggaattccggaaaatcctgcgtgaaaatggtgcgccggaggtaacgatcggggaaacctcaagtatgctctttacatgccgctccgagagaccaggacaggttacggtaaatgcgataacacgtaaaatggactttgcatgtctcccagcggcaaaagctggatgggccctggaacagatagggtcggttcttcctcaatacaaagctgtcgaaaacgtgttgcatacttcgctgactaatatcgaagctgtattgcacccgctgccaacactgttaaacgctgctcgttgtgagtctggtaccccattccattattataccgaggggattacgccatcagtcgggcgtcttgcggagaaagtggacgctgaacgcatagcaatcgcaaaggctttcgatttaaacgttccgtcggtctgcgaatggcataagaaaagttacggccagtcaccggccacaatttatgaagcggtgcagggtaatcctgctctgcgcggcattatgggacctaccagccttaacacggtgcacttcttcgaggatgtaagcaccggactggtaccgttatccgaactgggtcgggcagtgaatgtgcctaccccacttatcgatgctgttcttaccttgatcagttcgctgatagacacggatttcagaaaggaaggtcgtaccttggaaaaattaggtctgagcggacttaccgccgcggaaataagaagtgctgttgag

SEQ ID NO: 320 - protein, 359 aa, Artificial Sequence
  Engineered variant of opine dehydrogenase CENDH
MIESKTYAVLGLGNGGHAFAAYLALKGQRVLAWDIDAQRIKEIQDRGAIIAEGPGLAGTAHPDLLTSDIGLAVKDADVILIVVPAIHHASIAANIASYISEGQLIILNPGATGGALEFRKILRENGAPEVTIGETSSMLFTCRSERPGQVTVNAITRKMDFACLPAAKAGWALEQIGSVLPQYKAVENVLHTSLTNIEAVLHPLPTLLNAARCESGTPFHYYTEGITPSVGRLAEKVDAERIAIAKAFDLNVPSVCEWHKKSYGQSPATIYEAVQGNPALRGIMGPTSLNTVHFFEDVSTGLVPLSELGRAVNVPTPLIDAVLTLISSLIDTDFRKEGRTLEKLGLSGLTAAEIRSAVE

SEQ ID NO: 321 - DNA, 1077 bp, Artificial Sequence
  Engineered variant of opine dehydrogenase CENDH
atgatcgagtcaaaaacatacgccgttttgggattaggaaacgggggtcacgcatttgccgcctatttagcattgaagggccagcgtgtactggcttgggacatcgatgctcagagaatcaaagagattcaggaccgtggagccatcatagcggaaggaccaggacttgctgggactgctcacccggatcttctgacctcagatataggtttggcggttaaagacgctgatgtgatactgattgtagtgccggccatccaccacgcttccattgcagcaaatatcgccagttacatttccgagggtcagttgattatccttaaccctggggcaacgggtggagcgctggaattccggaaaatcctgcgtgaaaatggtgcgccggaggtaacgatcggggaaacctcaagtatgctctttacatgccgctccgagagaccaggacaggttacggtaaatgcgataacaggcgccatggactttgcatgtctcccagcggcaaaagctggatgggccctggaacagatagggtcggttcttcctcaataccaggctgtcgaaaacgtgttgcatacttcgctgactaatatcgaagctgtattgcacccgctgccaacactgttaaacgctgctcgttgtgagtctggtaccccattccattattataccgaggggattacgccatcagtcgggcgtcttgcggagaaagtggacgctgaacgcatagcaatcgcaaaggctttcgatttaaacgttccgtcggtctgcgaatggcataagaaaagttacggccagtcaccggccacaatttatgaagcggtgcagggtaatcctgctctgcgcggcattctgggacctaccagccttaacacggtgcacttcttcgaggatgtaagcaccggactggtaccgttatccgaactgggtcgggcagtgaatgtgcctaccccacttatcgatgctgttcttctgttgatcagttcgctgatagacacggatttcagaaaggaaggtcgtaccttggaaaaattaggtctgagcggacttaccgccgcggaaataagaagtgctgttgag

SEQ ID NO: 322 - protein, 359 aa, Artificial Sequence
  Engineered variant of opine dehydrogenase CENDH
MIESKTYAVLGLGNGGHAFAAYLALKGQRVLAWDIDAQRIKEIQDRGAIIAEGPGLAGTAHPDLLTSDIGLAVKDADVILIVVPAIHHASIAANIASYISEGQLIILNPGATGGALEFRKILRENGAPEVTIGETSSMLFTCRSERPGQVTVNAITGAMDFACLPAAKAGWALEQIGSVLPQYQAVENVLHTSLTNIEAVLHPLPTLLNAARCESGTPFHYYTEGITPSVGRLAEKVDAERIAIAKAFDLNVPSVCEWHKKSYGQSPATIYEAVQGNPALRGILGPTSLNTVHFFEDVSTGLVPLSELGRAVNVPTPLIDAVLLLISSLIDTDFRKEGRTLEKLGLSGLTAAEIRSAVE

SEQ ID NO: 323 - DNA, 1077 bp, Artificial Sequence
  Engineered variant of opine dehydrogenase CENDH
atgatcgagtcaaaaacatacgccgttttgggattaggaaacgggggtcacgcatttgccgcctatttagcattgaagggccagcgtgtactggcttgggacatcgatgctcagagaatcaaagagattcaggaccgtggagccatcatagcggaaggaccaggacttgctgggactgctcacccggatcttctgacctcagatataggtttggcggttaaagacgctgatgtgatactgattgtagtgccggccatccaccacgcttccattgcagcaaatatcgccagttacatttccgagggtcagttgattatccttaaccctggggcaacgggtggagcgctggaattccggaaaatcctgcgtgaaaatggtgcgccggaggtaacgatcggggaaacctcaagtatgctctttacatgccgctccgagagaccaggacaggttacggtaaatgcgataacaggcgccatggactttgcatgtctcccagcggcaaaagctggatgggccctggaacagatagggtcggttcttcctcaatacaaagctgtcgaaaacgtgttgcatacttcgctgactaatatcgaagctgtattgcacccgctgccaacactgttaaacgctgctcgttgtgagtctggtaccccattccattattataccgaggggattacgccatcagtcgggcgtcttgcggagaaagtggacgctgaacgcatagcaatcgcaaaggctttcgatttaaacgttccgtcggtctgcgaatggcataagagcagttacggccagtcaccggccacaatttatgaagcggtgcagggtaatcctgctctgcgcggcattatgggacctaccagccttaacacggtgcacttcttcgaggatgtaagcaccggactggtaccgttatccgaactgggtcgggcagtgaatgtgcctaccccacttatcgatgctgttcttaccttgatcagttcgctgatagacgtggatttcagaaaggaaggtcgtaccttggaaaaattaggtctgagcggacttaccgccgcggaaataagaagtgctgttgag

SEQ ID NO: 324 - protein, 359 aa, Artificial Sequence
  Engineered variant of opine dehydrogenase CENDH
MIESKTYAVLGLGNGGHAFAAYLALKGQRVLAWDIDAQRIKEIQDRGAIIAEGPGLAGTAHPDLLTSDIGLAVKDADVILIVVPAIHHASIAANIASYISEGQLIILNPGATGGALEFRKILRENGAPEVTIGETSSMLFTCRSERPGQVTVNAITGAMDFACLPAAKAGWALEQIGSVLPQYKAVENVLHTSLTNIEAVLHPLPTLLNAARCESGTPFHYYTEGITPSVGRLAEKVDAERIAIAKAFDLNVPSVCEWHKSSYGQSPATIYEAVQGNPALRGIMGPTSLNTVHFFEDVSTGLVPLSELGRAVNVPTPLIDAVLTLISSLIDVDFRKEGRTLEKLGLSGLTAAEIRSAVE

SEQ ID NO: 325 - DNA, 1077 bp, Artificial Sequence
  Engineered variant of opine dehydrogenase CENDH
atgatcgagtcaaaaacatacgccgttttgggattaggaaacgggggtcacgcatttgccgcctatttagcattgaagggccagcgtgtactggcttgggacatcgatgctcagagaatcaaagagattcaggaccgtggagccatcatagcggaaggaccaggacttgctgggactgctcacccggatcttctgacctcagatataggtttggcggttaaagacgctgatgtgatactgattgtagtgccggccatccaccacgcttccattgcagcaaatatcgccagttacatttccgagggtcagttgattatccttaaccctggggcaacgggtggagcgctggaattccggaaaatcctgcgtgaaaatggtgcgccggaggtaacgatcggggaaacctcaagtatgctctttacatgccgctccgagagaccaggacaggttacggtaaatgcgataacacgtaaaatggactttgcatgtctcccagcggcaaaagctggatgggccctggaacagatagggtcggttcttcctcaataccaggctgtcgaaaacgtgttgcatacttcgctgactaatatcgaagctgtattgcacccgctgccaacactgttaaacgctgctcgttgtgagtctggtaccccattcgattattataccgaggggattacgccatcagtcggggcgcttgcggagaaagtggacgctgaacgcatagcaatcgcaaaggctttcgatttaaacgttccgtcggtctgcgaatggcataagattagttacggccagtcaccggccacaatttatgaagcggtgcagggtaatcctgctctgcgcggcattgcgggacctaccagccttaacacggtgcacttcttcgaggatgtaagcaccggactggtaccgttatccgaactgggtcgggcagtgaatgtgcctaccccacttatcgatgctgttcttgacttgatcagttcgctgatagacacggatttcagaaaggaaggtcgtaccttggaaaaattaggtctgagcggacttaccgccgcgggcataagaagtgctgttgag

SEQ ID NO: 326 - protein, 359 aa, Artificial Sequence
  Engineered variant of opine dehydrogenase CENDH
MIESKTYAVLGLGNGGHAFAAYLALKGQRVLAWDIDAQRIKEIQDRGAIIAEGPGLAGTAHPDLLTSDIGLAVKDADVILIVVPAIHHASIAANIASYISEGQLIILNPGATGGALEFRKILRENGAPEVTIGETSSMLFTCRSERPGQVTVNAITRKMDFACLPAAKAGWALEQIGSVLPQYQAVENVLHTSLTNIEAVLHPLPTLLNAARCESGTPFDYYTEGITPSVGALAEKVDAERIAIAKAFDLNVPSVCEWHKISYGQSPATIYEAVQGNPALRGIAGPTSLNTVHFFEDVSTGLVPLSELGRAVNVPTPLIDAVLDLISSLIDTDFRKEGRTLEKLGLSGLTAAGIRSAVE

SEQ ID NO: 327 - DNA, 1077 bp, Artificial Sequence
  Engineered variant of opine dehydrogenase CENDH
atgatcgagtcaaaaacatacgccgttttgggattaggaaacgggggtcacgcatttgccgcctatttagcattgaagggccagcgtgtactggcttgggacatcgatgctcagagaatcaaagagattcaggaccgtggagccatcatagcggaaggaccaggacttgctgggactgctcacccggatcttctgacctcagatataggtttggcggttaaagacgctgatgtgatactgattgtagtgccggccatccaccacgcttccattgcagcaaatatcgccagttacatttccgagggtcagttgattatccttaaccctggggcaacgggtggagcgctggaattccggaaaatcctgcgtgaaaatggtgcgccggaggtaacgatcggggaaacctcaagtatgctctttacatgccgctccgagagaccaggacaggttacggtaaatgcgataacacgtgccatggactttgcatgtctcccagcggcaaaagctggatgggccctggaacagatagggtcggttcttcctcaataccgtgctgtcgaaaacgtgttgcatacttcgctgactaatatcgaagctgtattgcacccgctgccaacactgttaaacgctgctcgttgtgagtctggtaccccattcgattattataccgaggggattacgccatcagtcggggcgcttgcggagaaagtggacgctgaacgcatagcaatcgcaaaggctttcgatttaaacgttccgtcggtctgcgaatggcataagattagttacggccagtcaccggccacaatttatgaagcggtgcagggtaatcctgctctgcgcggcattatgggacctaccagccttaacacggtgcacttcttcgaggatgtaagcaccggactggtaccgttatccgaactgggtcgggcagtgaatgtgcctaccccacttatcgatgctgttcttgacttgatcagttcgctgatagacacggatttcagaaaggaaggtcgtaccttggaaaaattaggtctgagcggacttaccgccgcgggcataagaagtgctgttgag

SEQ ID NO: 328 - protein, 359 aa, Artificial Sequence
  Engineered variant of opine dehydrogenase CENDH
MIESKTYAVLGLGNGGHAFAAYLALKGQRVLAWDIDAQRIKEIQDRGAIIAEGPGLAGTAHPDLLTSDIGLAVKDADVILIVVPAIHHASIAANIASYISEGQLIILNPGATGGALEFRKILRENGAPEVTIGETSSMLFTCRSERPGQVTVNAITRAMDFACLPAAKAGWALEQIGSVLPQYRAVENVLHTSLTNIEAVLHPLPTLLNAARCESGTPFDYYTEGITPSVGALAEKVDAERIAIAKAFDLNVPSVCEWHKISYGQSPATIYEAVQGNPALRGIMGPTSLNTVHFFEDVSTGLVPLSELGRAVNVPTPLIDAVLDLISSLIDTDFRKEGRTLEKLGLSGLTAAGIRSAVE

SEQ ID NO: 329 - DNA, 1077 bp, Artificial Sequence
  Engineered variant of opine dehydrogenase CENDH
atgatcgagtcaaaaacatacgccgttttgggattaggaaacgggggtcacgcatttgccgcctatttagcattgaagggccagcgtgtactggcttgggacatcgatgctcagagaatcaaagagattcaggaccgtggagccatcatagcggaaggaccaggacttgctgggactgctcacccggatcttctgacctcagatataggtttggcggttaaagacgctgatgtgatactgattgtagtgccggccatccaccacgcttccattgcagcaaatatcgccagttacatttccgagggtcagttgattatccttaaccctggggcaacgggtggagcgctggaattccggaaaatcctgcgtgaaaatggtgcgccggaggtaacgatcggggaaacctcaagtatgctctttacatgccgctccgagagaccaggacaggttacggtaaatgcgataacacgtgccatggactttgcatgtctcccagcggcaaaagctggatgggccctggaacagatagggtcggttcttcctcaataccgtgctgtcgaaaacgtgttgcatacttcgctgactaatatcgaagctgtattgcacccgctgccaacactgttaaacgctgctcgttgtgagtctggtaccccattccattattataccgaggggattacgccatcagtcgggcgtcttgcggagaaagtggacgctgaacgcatagcaatcgcaaaggctttcgatttaaacgttccgtcggtctgcgaatggcataagaaaagttacggccagtcaccggccacaatttatgaagcggtgcagggtaatcctgctctgcgcggcattctgggacctaccagccttaacacggtgcacttcttcgaggatgtaagcaccggactggtaccgttatccgaactgggtcgggcagtgaatgtgcctaccccacttatcgatgctgttcttgacttgatcagttcgctgatagacacggatttcagaaaggaaggtcgtaccttggaaaaattaggtctgagcggacttaccgccgcgggcataagaagtgctgttgag

SEQ ID NO: 330 - protein, 359 aa, Artificial Sequence
  Engineered variant of opine dehydrogenase CENDH
MIESKTYAVLGLGNGGHAFAAYLALKGQRVLAWDIDAQRIKEIQDRGAIIAEGPGLAGTAHPDLLTSDIGLAVKDADVILIVVPAIHHASIAANIASYISEGQLIILNPGATGGALEFRKILRENGAPEVTIGETSSMLFTCRSERPGQVTVNAITRAMDFACLPAAKAGWALEQIGSVLPQYRAVENVLHTSLTNIEAVLHPLPTLLNAARCESGTPFHYYTEGITPSVGRLAEKVDAERIAIAKAFDLNVPSVCEWHKKSYGQSPATIYEAVQGNPALRGILGPTSLNTVHFFEDVSTGLVPLSELGRAVNVPTPLIDAVLDLISSLIDTDFRKEGRTLEKLGLSGLTAAGIRSAVE

SEQ ID NO: 331 - DNA, 1077 bp, Artificial Sequence
  Engineered variant of opine dehydrogenase CENDH
atgatcgagtcaaaaacatacgccgttttgggattaggaaacgggggtcacgcatttgccgcctatttagcattgaagggccagcgtgtactggcttgggacatcgatgctcagagaatcaaagagattcaggaccgtggagccatcatagcggaaggaccaggacttgctgggactgctcacccggatcttctgacctcagatataggtttggcggttaaagacgctgatgtgatactgattgtagtgccggccatccaccacgcttccattgcagcaaatatcgccagttacatttccgagggtcagttgattatccttaaccctggggcaacgggtggagcgctggaattccggaaaatcctgcgtgaaaatggtgcgccggaggtaacgatcggggaaacctcaagtatgctctttacatgccgctccgagagaccaggacaggttacggtaaatgcgataacacgtgccatggactttgcatgtctcccagcggcaaaagctggatgggccctggaacagatagggtcggttcttcctcaataccaggctgtcgaaaacgtgttgcatacttcgctgactaatatcgaagctgtattgcacccgctgccaacactgttaaacgctgctcgttgtgagtctggtaccccattccattattataccgaggggattacgccatcagtcggggcgcttgcggagaaagtggacgctgaacgcatagcaatcgcaaaggctttcgatttaaacgttccgtcggtctgcgaatggcataagcgtagttacggccagtcaccggccacaatttatgaagcggtgcagggtaatcctgctctgcgcggcattatgggacctaccagccttaacacggtgcacttcttcgaggatgtaagcaccggactggtaccgttatccgaactgggtcgggcagtgaatgtgcctaccccacttatcgatgctgttcttgacttgatcagttcgctgatagacacggatttcagaaaggaaggtcgtaccttggaaaaattaggtctgagcggacttaccgccgcggaaataagaagtgctgttgag

SEQ ID NO: 332 - protein, 359 aa, Artificial Sequence
  Engineered variant of opine dehydrogenase CENDH
MIESKTYAVLGLGNGGHAFAAYLALKGQRVLAWDIDAQRIKEIQDRGAIIAEGPGLAGTAHPDLLTSDIGLAVKDADVILIVVPAIHHASIAANIASYISEGQLIILNPGATGGALEFRKILRENGAPEVTIGETSSMLFTCRSERPGQVTVNAITRAMDFACLPAAKAGWALEQIGSVLPQYQAVENVLHTSLTNIEAVLHPLPTLLNAARCESGTPFHYYTEGITPSVGALAEKVDAERIAIAKAFDLNVPSVCEWHKRSYGQSPATIYEAVQGNPALRGIMGPTSLNTVHFFEDVSTGLVPLSELGRAVNVPTPLIDAVLDLISSLIDTDFRKEGRTLEKLGLSGLTAAEIRSAVE

SEQ ID NO: 333 - DNA, 1077 bp, Artificial Sequence
  Engineered variant of opine dehydrogenase CENDH
atgatcgagtcaaaaacatacgccgttttgggattaggaaacgggggtcacgcatttgccgcctatttagcattgaagggccagcgtgtactggcttgggacatcgatgctcagagaatcaaagagattcaggaccgtggagccatcatagcggaaggaccaggacttgctgggactgctcacccggatcttctgacctcagatataggtttggcggttaaagacgctgatgtgatactgattgtagtgccggccatccaccacgcttccattgcagcaaatatcgccagttacatttccgagggtcagttgattatccttaaccctggggcaacgggtggagcgctggaattccggaaaatcctgcgtgaaaatggtgcgccggaggtaacgatcggggaaacctcaagtatgctctttacatgccgctccgagagaccaggacaggttacggtaaatgcgataacaggcgccatggactttgcatgtctcccagcggcaaaagctggatgggccctggaacagatagggtcggttcttcctcaataccaggctgtcgaaaacgtgttgcatacttcgctgactaatatcgaagctgtattgcacccgctgccaacactgttaaacgctgctcgttgtgagtctggtaccccattccaatattataccgaggggattacgccatcagtcgggcgtcttgcggagaaagtggacgctgaacgcatagcaatcgcaaaggctttcgatttaaacgttccgtcggtctgcgaatggcataagcgtagttacggccagtcaccggccacaatttatgaagcggtgcagggtaatcctgctctgcgcggcattctgggacctaccaaccttaacacggtgcacttcttcgaggatgtaagcaccggactggtaccgttatccgaactgggtcgggcagtgaatgtgcctaccccacttatcgatgctgttcttgacttgatcagttcgctgatagacgtggatttcagaaaggaaggtcgtaccttggaaaaattaggtctgagcggacttaccgccgcggaaataagaagtgctgttgag

SEQ ID NO: 334 - protein, 359 aa, Artificial Sequence
  Engineered variant of opine dehydrogenase CENDH
MIESKTYAVLGLGNGGHAFAAYLALKGQRVLAWDIDAQRIKEIQDRGAIIAEGPGLAGTAHPDLLTSDIGLAVKDADVILIVVPAIHHASIAANIASYISEGQLIILNPGATGGALEFRKILRENGAPEVTIGETSSMLFTCRSERPGQVTVNAITGAMDFACLPAAKAGWALEQIGSVLPQYQAVENVLHTSLTNIEAVLHPLPTLLNAARCESGTPFQYYTEGITPSVGRLAEKVDAERIAIAKAFDLNVPSVCEWHKRSYGQSPATIYEAVQGNPALRGILGPTNLNTVHFFEDVSTGLVPLSELGRAVNVPTPLIDAVLDLISSLIDVDFRKEGRTLEKLGLSGLTAAEIRSAVE

SEQ ID NO: 335 - DNA, 1077 bp, Artificial Sequence
  Engineered variant of opine dehydrogenase CENDH
atgatcgagtcaaaaacatacgccgttttgggattaggaaacgggggtcacgcatttgccgcctatttagcattgaagggccagcgtgtactggcttgggacatcgatgctcagagaatcaaagagattcaggaccgtggagccatcatagcggaaggaccaggacttgctgggactgctcacccggatcttctgacctcagatataggtttggcggttaaagacgctgatgtgatactgattgtagtgccggccatccaccacgcttccattgcagcaaatatcgccagttacatttccgagggtcagttgattatccttaaccctggggcaacgggtggagcgctggaattccggaaaatcctgcgtgaaaatggtgcgccggaggtaacgatcggggaaacctcaagtatgctctttacatgccgctccgagagaccaggacaggttacggtaaatgcgataacaggcgccatggactttgcatgtctcccagcggcaaaagctggatgggccctggaacagatagggtcggttcttcctcaataccgtgctgtcgaaaacgtgttgcatacttcgctgactaatatcgaagctgtattgcacccgctgccaacactgttaaacgctgctcgttgtgagtctggtaccccattcgattattataccgaggggattacgccatcagtcgggagtcttgcggagaaagtggacgctgaacgcatagcaatcgcaaaggctttcgatttaaacgttccgtcggtctgcgaatggcataagattagttacggccagtcaccggccacaatttatgaagcggtgcagggtaatcctgctctgcgcggcattgcgggacctaccagccttaacacggtgcacttcttcgaggatgtaagcaccggactggtaccgttatccgaactgggtcgggcagtgaatgtgcctaccccacttatcgatgctgttcttaccttgatcagttcgctgatagacgtggatttcagaaaggaaggtcgtaccttggaaaaattaggtctgagcggacttaccgccgcggaaataagaagtgctgttgag

SEQ ID NO: 336 - protein, 359 aa, Artificial Sequence
  Engineered variant of opine dehydrogenase CENDH
MIESKTYAVLGLGNGGHAFAAYLALKGQRVLAWDIDAQRIKEIQDRGAIIAEGPGLAGTAHPDLLTSDIGLAVKDADVILIVVPAIHHASIAANIASYISEGQLIILNPGATGGALEFRKILRENGAPEVTIGETSSMLFTCRSERPGQVTVNAITGAMDFACLPAAKAGWALEQIGSVLPQYRAVENVLHTSLTNIEAVLHPLPTLLNAARCESGTPFDYYTEGITPSVGSLAEKVDAERIAIAKAFDLNVPSVCEWHKISYGQSPATIYEAVQGNPALRGIAGPTSLNTVHFFEDVSTGLVPLSELGRAVNVPTPLIDAVLTLISSLIDVDFRKEGRTLEKLGLSGLTAAEIRSAVE

SEQ ID NO: 337 - DNA, 1077 bp, Artificial Sequence
  Engineered variant of opine dehydrogenase CENDH
atgatcgagtcaaaaacatacgccgttttgggattaggaaacgggggtcacgcatttgccgcctatttagcattgaagggccagcgtgtactggcttgggacatcgatgctcagagaatcaaagagattcaggaccgtggagccatcatagcggaaggaccaggacttgctgggactgctcacccggatcttctgacctcagatataggtttggcggttaaagacgctgatgtgatactgattgtagtgccggccatccaccacgcttccattgcagcaaatatcgccagttacatttccgagggtcagttgattatccttaaccctggggcaacgggtggagcgctggaattccggaaaatcctgcgtgaaaatggtgcgccggaggtaacgatcggggaaacctcaagtatgctctttacatgccgctccgagagaccaggacaggttacggtaaatgcgataacacgtgccatggactttgcatgtctcccagcggcaaaagctggatgggccctggaacagatagggtcggttcttcctcaataccaggctgtcgaaaacgtgttgcatacttcgctgactaatatcgaagctgtattgcacccgctgccaacactgttaaacgctgctcgttgtgagtctggtaccccattccattattataccgaggggattacgccatcagtcgggcgtcttgcggagaaagtggacgctgaacgcatagcaatcgcaaaggctttcgatttaaacgttccgtcggtctgcgaatggcataagagcagttacggccagtcaccggccacaatttatgaagcggtgcagggtaatcctgctctgcgcggcattatgggacctaccagccttaacacggtgcacttcttcgaggatgtaagcaccggactggtaccgttatccgaactgggtcgggcagtgaatgtgcctaccccacttatcgatgctgttcttaccttgatcagttcgctgatagacacggatttcagaaaggaaggtcgtaccttggaaaaattaggtctgagcggacttaccgccgcgggcataagaagtgctgttgag

SEQ ID NO: 338 - protein, 359 aa, Artificial Sequence
  Engineered variant of opine dehydrogenase CENDH
MIESKTYAVLGLGNGGHAFAAYLALKGQRVLAWDIDAQRIKEIQDRGAIIAEGPGLAGTAHPDLLTSDIGLAVKDADVILIVVPAIHHASIAANIASYISEGQLIILNPGATGGALEFRKILRENGAPEVTIGETSSMLFTCRSERPGQVTVNAITRAMDFACLPAAKAGWALEQIGSVLPQYQAVENVLHTSLTNIEAVLHPLPTLLNAARCESGTPFHYYTEGITPSVGRLAEKVDAERIAIAKAFDLNVPSVCEWHKSSYGQSPATIYEAVQGNPALRGIMGPTSLNTVHFFEDVSTGLVPLSELGRAVNVPTPLIDAVLTLISSLIDTDFRKEGRTLEKLGLSGLTAAGIRSAVE

SEQ ID NO: 339 - DNA, 1077 bp, Artificial Sequence
  Engineered variant of opine dehydrogenase CENDH
atgatcgagtcaaaaacatacgccgttttgggattaggaaacgggggtcacgcatttgccgcctatttagcattgaagggccagcgtgtactggcttgggacatcgatgctcagagaatcaaagagattcaggaccgtggagccatcatagcggaaggaccaggacttgctgggactgctcacccggatcttctgacctcagatataggtttggcggttaaagacgctgatgtgatactgattgtagtgccggccatccaccacgcttccattgcagcaaatatcgccagttacatttccgagggtcagttgattatccttaaccctggggcaacgggtggagcgctggaattccggaaaatcctgcgtgaaaatggtgcgccggaggtaacgatcggggaaacctcaagtatgctctttacatgccgctccgagagaccaggacaggttacggtaaatgcgataacaggcgccatggactttgcatgtctcccagcggcaaaagctggatgggccctggaacagatagggtcggttcttcctcaataccaggctgtcgaaaacgtgttgcatacttcgctgactaatatcgaagctgtattgcacccgctgccaacactgttaaacgctgctcgttgtgagtctggtaccccattccattattataccgaggggattacgccatcagtcgggcgtcttgcggagaaagtggacgctgaacgcatagcaatcgcaaaggctttcgatttaaacgttccgtcggtctgcgaatggcataagattagttacggccagtcaccggccacaatttatgaagcggtgcagggtaatcctgctctgcgcggcattctgggacctaccagccttaacacggtgcacttcttcgaggatgtaagcaccggactggtaccgttatccgaactgggtcgggcagtgaatgtgcctaccccacttatcgatgctgttcttgacttgatcagttcgctgatagacgtggatttcagaaaggaaggtcgtaccttggaaaaattaggtctgagcggacttaccgccgcgggcataagaagtgctgttgag

SEQ ID NO: 340 - protein, 359 aa, Artificial Sequence
  Engineered variant of opine dehydrogenase CENDH
MIESKTYAVLGLGNGGHAFAAYLALKGQRVLAWDIDAQRIKEIQDRGAIIAEGPGLAGTAHPDLLTSDIGLAVKDADVILIVVPAIHHASIAANIASYISEGQLIILNPGATGGALEFRKILRENGAPEVTIGETSSMLFTCRSERPGQVTVNAITGAMDFACLPAAKAGWALEQIGSVLPQYQAVENVLHTSLTNIEAVLHPLPTLLNAARCESGTPFHYYTEGITPSVGRLAEKVDAERIAIAKAFDLNVPSVCEWHKISYGQSPATIYEAVQGNPALRGILGPTSLNTVHFFEDVSTGLVPLSELGRAVNVPTPLIDAVLDLISSLIDVDFRKEGRTLEKLGLSGLTAAGIRSAVE

SEQ ID NO: 341 - DNA, 1077 bp, Artificial Sequence
  Engineered variant of opine dehydrogenase CENDH
atgatcgagtcaaaaacatacgccgttttgggattaggaaacgggggtcacgcatttgccgcctatttagcattgaagggccagcgtgtactggcttgggacatcgatgctcagagaatcaaagagattcaggaccgtggagccatcatagcggaaggaccaggacttgctgggactgctcacccggatcttctgacctcagatataggtttggcggttaaagacgctgatgtgatactgattgtagtgccggccatccaccacgcttccattgcagcaaatatcgccagttacatttccgagggtcagttgattatccttaaccctggggcaacgggtggagcgctggaattccggaaaatcctgcgtgaaaatggtgcgccggaggtaacgatcggggaaacctcaagtatgctctttacatgccgctccgagagaccaggacaggttacggtaaatgcgataacacgtgccatggactttgcatgtctcccagcggcaaaagctggatgggccctggaacagatagggtcggttcttcctcaatacaaagctgtcgaaaacgtgttgcatacttcgctgactaatatcgaagctgtattgcacccgctgccaacactgttaaacgctgctcgttgtgagtctggtaccccattcgattattataccgaggggattacgccatcagtcggggcgcttgcggagaaagtggacgctgaacgcatagcaatcgcaaaggctttcgatttaaacgttccgtcggtctgcgaatggcataagattagttacggccagtcaccggccacaatttatgaagcggtgcagggtaatcctgctctgcgcggcattatgggacctaccagccttaacacggtgcacttcttcgaggatgtaagcaccggactggtaccgttatccgaactgggtcgggcagtgaatgtgcctaccccacttatcgatgctgttcttgacttgatcagttcgctgatagacacggatttcagaaaggaaggtcgtaccttggaaaaattaggtctgagcggacttaccgccgcggaaataagaagtgctgttgag

SEQ ID NO: 342 - protein, 359 aa, Artificial Sequence
  Engineered variant of opine dehydrogenase CENDH
MIESKTYAVLGLGNGGHAFAAYLALKGQRVLAWDIDAQRIKEIQDRGAIIAEGPGLAGTAHPDLLTSDIGLAVKDADVILIVVPAIHHASIAANIASYISEGQLIILNPGATGGALEFRKILRENGAPEVTIGETSSMLFTCRSERPGQVTVNAITRAMDFACLPAAKAGWALEQIGSVLPQYKAVENVLHTSLTNIEAVLHPLPTLLNAARCESGTPFDYYTEGITPSVGALAEKVDAERIAIAKAFDLNVPSVCEWHKISYGQSPATIYEAVQGNPALRGIMGPTSLNTVHFFEDVSTGLVPLSELGRAVNVPTPLIDAVLDLISSLIDTDFRKEGRTLEKLGLSGLTAAEIRSAVE

SEQ ID NO: 343 - DNA, 1077 bp, Artificial Sequence
  Engineered variant of opine dehydrogenase CENDH
atgatcgagtcaaaaacatacgccgttttgggattaggaaacgggggtcacgcatttgccgcctatttagcattgaagggccagcgtgtactggcttgggacatcgatgctcagagaatcaaagagattcaggaccgtggagccatcatagcggaaggaccaggacttgctgggactgctcacccggatcttctgacctcagatataggtttggcggttaaagacgctgatgtgatactgattgtagtgccggccatccaccacgcttccattgcagcaaatatcgccagttacatttccgagggtcagttgattatccttaaccctggggcaacgggtggagcgctggaattccggaaaatcctgcgtgaaaatggtgcgccggaggtaacgatcggggaaacctcaagtatgctctttacatgccgctccgagagaccaggacaggttacggtaaatgcgataacacgtgccatggactttgcatgtctcccagcggcaaaagctggatgggccctggaacagatagggtcggttcttcctcaatacaaagctgtcgaaaacgtgttgcatacttcgctgactaatatcgaagctgtattgcacccgctgccaacactgttaaacgctgctcgttgtgagtctggtaccccattccaatattataccgaggggattacgccatcagtcgggcgtcttgcggagaaagtggacgctgaacgcatagcaatcgcaaaggctttcgatttaaacgttccgtcggtctgcgaatggcataagagcagttacggccagtcaccggccacaatttatgaagcggtgcagggtaatcctgctctgcgcggcattctgggacctaccagccttaacacggtgcacttcttcgaggatgtaagcaccggactggtaccgttatccgaactgggtcgggcagtgaatgtgcctaccccacttatcgatgctgttcttaccttgatcagttcgctgatagacacggatttcagaaaggaaggtcgtaccttggaaaaattaggtctgagcggacttaccgccgcggaaataagaagtgctgttgag

SEQ ID NO: 344 - protein, 359 aa, Artificial Sequence
  Engineered variant of opine dehydrogenase CENDH
MIESKTYAVLGLGNGGHAFAAYLALKGQRVLAWDIDAQRIKEIQDRGAIIAEGPGLAGTAHPDLLTSDIGLAVKDADVILIVVPAIHHASIAANIASYISEGQLIILNPGATGGALEFRKILRENGAPEVTIGETSSMLFTCRSERPGQVTVNAITRAMDFACLPAAKAGWALEQIGSVLPQYKAVENVLHTSLTNIEAVLHPLPTLLNAARCESGTPFQYYTEGITPSVGRLAEKVDAERIAIAKAFDLNVPSVCEWHKSSYGQSPATIYEAVQGNPALRGILGPTSLNTVHFFEDVSTGLVPLSELGRAVNVPTPLIDAVLTLISSLIDTDFRKEGRTLEKLGLSGLTAAEIRSAVE

SEQ ID NO: 345 - DNA, 1077 bp, Artificial Sequence
  Engineered variant of opine dehydrogenase CENDH
atgatcgagtcaaaaacatacgccgttttgggattaggaaacgggggtcacgcatttgccgcctatttagcattgaagggccagcgtgtactggcttgggacatcgatgctcagagaatcaaagagattcaggaccgtggagccatcatagcggaaggaccaggacttgctgggactgctcacccggatcttctgacctcagatataggtttggcggttaaagacgctgatgtgatactgattgtagtgccggccatccaccacgcttccattgcagcaaatatcgccccgtacatttccgagggtcagttgattatccttaaccctggggcaacgggtggagcgctggaattccggaaaatcctgcgtgaaaatggtgcgccggaggtaacgatcggggaaacctcaagtatgctctttacatgccgctccgagagaccaggacaggttacggtaaatgcgataacacgtgccatggactttgcatgtctcccagcggcaaaagctggatgggccctggaacagatagggtcggttcttcctcaataccaggctgtcgaaaacgtgttgcatacttcgctgactaatatcgaagctgtattgcacccgctgccaacactgttaaacgctgctcgttgtgagtctggtaccccattccattattataccgaggggattacgccatcagtcgggagtcttgcggagaaagtggacgctgaacgcatagcaatcgcaaaggctttcgatttaaacgttccgtcggtctgcgaatggcataagaaaagttacggccagtcaccggccacaatttatgaagcggtgcagggtaatcctgctctgcgcggcattatgggacctaccagccttaacacggtgcacttcttcgaggatgtaagcaccggactggtaccgttatccgaactgggtcgggcagtgaatgtgcctaccccacttatcgatgctgttcttgacttgatcagttcgctgatagacacggatttcagaaaggaaggtcgtaccttggaaaaattaggtctgagcggacttaccgccgcggaaataagaagtgctgttgag

SEQ ID NO: 346 - protein, 359 aa, Artificial Sequence
  Engineered variant of opine dehydrogenase CENDH
MIESKTYAVLGLGNGGHAFAAYLALKGQRVLAWDIDAQRIKEIQDRGAIIAEGPGLAGTAHPDLLTSDIGLAVKDADVILIVVPAIHHASIAANIAPYISEGQLIILNPGATGGALEFRKILRENGAPEVTIGETSSMLFTCRSERPGQVTVNAITRAMDFACLPAAKAGWALEQIGSVLPQYQAVENVLHTSLTNIEAVLHPLPTLLNAARCESGTPFHYYTEGITPSVGSLAEKVDAERIAIAKAFDLNVPSVCEWHKKSYGQSPATIYEAVQGNPALRGIMGPTSLNTVHFFEDVSTGLVPLSELGRAVNVPTPLIDAVLDLISSLIDTDFRKEGRTLEKLGLSGLTAAEIRSAVE

SEQ ID NO: 347 - DNA, 1077 bp, Artificial Sequence
  Engineered variant of opine dehydrogenase CENDH
atgatcgagtcaaaaacatacgccgttttgggattaggaaacgggggtcacgcatttgccgcctatttagcattgaagggccagcgtgtactggcttgggacatcgatgctcagagaatcaaagagattcaggaccgtggagccatcatagcggaaggaccaggacttgctgggactgctcacccggatcttctgacctcagatataggtttggcggttaaagacgctgatgtgatactgattgtagtgccggccatccaccacgcttccattgcagcaaatatcgccagttacatttccgagggtcagttgattatccttaaccctggggcaacgggtggagcgctggaattccggaaaatcctgcgtgaaaatggtgcgccggaggtaacgatcggggaaacctcaagtatgctctttacatgccgctccgagagaccaggacaggttacggtaaatgcgataacacgtaaaatggactttgcatgtctcccagcggcaaaagctggatgggccctggaacagatagggtcggttcttcctcaatacaaagctgtcgaaaacgtgttgcatacttcgctgactaatatcgaagctgtattgcacccgctgccaacactgttaaacgctgctcgttgtgagtctggtaccccattcgattattataccgaggggattacgccatcagtcgggcgtcttgcggagaaagtggacgctgaacgcatagcaatcgcaaaggctttcgatttaaacgttccgtcggtctgcgaatggcataagattagttacggccagtcaccggccacaatttatgaagcggtgcagggtaatcctgctctgcgcggcattgcgggacctaccagccttaacacggtgcacttcttcgaggatgtaagcaccggactggtaccgttatccgaactgggtcgggcagtgaatgtgcctaccccacttatcgatgctgttcttaccttgatcagttcgctgatagacacggatttcagaaaggaaggtcgtaccttggaaaaattaggtctgagcggacttaccgccgcggaaataagaagtgctgttgag

SEQ ID NO: 348 - protein, 359 aa, Artificial Sequence
  Engineered variant of opine dehydrogenase CENDH
MIESKTYAVLGLGNGGHAFAAYLALKGQRVLAWDIDAQRIKEIQDRGAIIAEGPGLAGTAHPDLLTSDIGLAVKDADVILIVVPAIHHASIAANIASYISEGQLIILNPGATGGALEFRKILRENGAPEVTIGETSSMLFTCRSERPGQVTVNAITRKMDFACLPAAKAGWALEQIGSVLPQYKAVENVLHTSLTNIEAVLHPLPTLLNAARCESGTPFDYYTEGITPSVGRLAEKVDAERIAIAKAFDLNVPSVCEWHKISYGQSPATIYEAVQGNPALRGIAGPTSLNTVHFFEDVSTGLVPLSELGRAVNVPTPLIDAVLTLISSLIDTDFRKEGRTLEKLGLSGLTAAEIRSAVE

SEQ ID NO: 349 - DNA, 1077 bp, Artificial Sequence
  Engineered variant of opine dehydrogenase CENDH
atgatcgagtcaaaaacatacgccgttttgggattaggaaacgggggtcacgcatttgccgcctatttagcattgaagggccagcgtgtactggcttgggacatcgatgctcagagaatcaaagagattcaggaccgtggagccatcatagcggaaggaccaggacttgctgggactgctcacccggatcttctgacctcagatataggtttggcggttaaagacgctgatgtgatactgattgtagtgccggccatccaccacgcttccattgcagcaaatatcgccagttacatttccgagggtcagttgattatccttaaccctggggcaacgggtggagcgctggaattccggaaaatcctgcgtgaaaatggtgcgccggaggtaacgatcggggaaacctcaagtatgctctttacatgccgctccgagagaccaggacaggttacggtaaatgcgataacacgtgccatggactttgcatgtctcccagcggcaaaagctggatgggccctggaacagatagggtcggttcttcctcaataccaggctgtcgaaaacgtgttgcatacttcgctgactaatatcgaagctgtattgcacccgctgccaacactgttaaacgctgctcgttgtgagtctggtaccccattccaatattataccgaggggattacgccatcagtcgggagtcttgcggagaaagtggacgctgaacgcatagcaatcgcaaaggctttcgatttaaacgttccgtcggtctgcgaatggcataagattagttacggccagtcaccggccacaatttatgaagcggtgcagggtaatcctgctctgcgcggcattatgggacctaccagccttaacacggtgcacttcttcgaggatgtaagcaccggactggtaccgttatccgaactgggtcgggcagtgaatgtgcctaccccacttatcgatgctgttcttgacttgatcagttcgctgatagacacggatttcagaaaggaaggtcgtaccttggaaaaattaggtctgagcggacttaccgccgcgggcataagaagtgctgttgag

SEQ ID NO: 350 - protein, 359 aa, Artificial Sequence
  Engineered variant of opine dehydrogenase CENDH
MIESKTYAVLGLGNGGHAFAAYLALKGQRVLAWDIDAQRIKEIQDRGAIIAEGPGLAGTAHPDLLTSDIGLAVKDADVILIVVPAIHHASIAANIASYISEGQLIILNPGATGGALEFRKILRENGAPEVTIGETSSMLFTCRSERPGQVTVNAITRAMDFACLPAAKAGWALEQIGSVLPQYQAVENVLHTSLTNIEAVLHPLPTLLNAARCESGTPFQYYTEGITPSVGSLAEKVDAERIAIAKAFDLNVPSVCEWHKISYGQSPATIYEAVQGNPALRGIMGPTSLNTVHFFEDVSTGLVPLSELGRAVNVPTPLIDAVLDLISSLIDTDFRKEGRTLEKLGLSGLTAAGIRSAVE

SEQ ID NO: 351 - DNA, 1077 bp, Artificial Sequence
  Engineered variant of opine dehydrogenase CENDH
atgatcgagtcaaaaacatacgccgttttgggattaggaaacgggggtcacgcatttgccgcctatttagcattgaagggccagcgtgtactggcttgggacatcgatgctcagagaatcaaagagattcaggaccgtggagccatcatagcggaaggaccaggacttgctgggactgctcacccggatcttctgacctcagatataggtttggcggttaaagacgctgatgtgatactgattgtagtgccggccatccaccacgcttccattgcagcaaatatcgccagttacatttccgagggtcagttgattatccttaaccctggggcaacgggtggagcgctggaattccggaaaatcctgcgtgaaaatggtgcgccggaggtaacgatcggggaaacctcaagtatgctctttacatgccgctccgagagaccaggacaggttacggtaaatgcgataacaggcgccatggactttgcatgtctcccagcggcaaaagctggatgggccctggaacagatagggtcggttcttcctcaataccaggctgtcgaaaacgtgttgcatacttcgctgactaatatcgaagctgtattgcacccgctgccaacactgttaaacgctgctcgttgtgagtctggtaccccattccattattataccgaggggattacgccatcagtcgggcgtcttgcggagaaagtggacgctgaacgcatagcaatcgcaaaggctttcgatttaaacgttccgtcggtctgcgaatggcataagcgtagttacggccagtcaccggccacaatttatgaagcggtgcagggtaatcctgctctgcgcggcattatgggacctaccagccttaacacggtgcacttcttcgaggatgtaagcaccggactggtaccgttatccgaactgggtcgggcagtgaatgtgcctaccccacttatcgatgctgttcttgacttgatcagttcgctgatagacacggatttcagaaaggaaggtcgtaccttggaaaaattaggtctgagcggacttaccgccgcgggcataagaagtgctgttgag

SEQ ID NO: 352 - protein, 359 aa, Artificial Sequence
  Engineered variant of opine dehydrogenase CENDH
MIESKTYAVLGLGNGGHAFAAYLALKGQRVLAWDIDAQRIKEIQDRGAIIAEGPGLAGTAHPDLLTSDIGLAVKDADVILIVVPAIHHASIAANIASYISEGQLIILNPGATGGALEFRKILRENGAPEVTIGETSSMLFTCRSERPGQVTVNAITGAMDFACLPAAKAGWALEQIGSVLPQYQAVENVLHTSLTNIEAVLHPLPTLLNAARCESGTPFHYYTEGITPSVGRLAEKVDAERIAIAKAFDLNVPSVCEWHKRSYGQSPATIYEAVQGNPALRGIMGPTSLNTVHFFEDVSTGLVPLSELGRAVNVPTPLIDAVLDLISSLIDTDFRKEGRTLEKLGLSGLTAAGIRSAVE

SEQ ID NO: 353 - DNA, 1077 bp, Artificial Sequence
  Engineered variant of opine dehydrogenase CENDH
atgatcgagtcaaaaacatacgccgttttgggattaggaaacgggggtcacgcatttgccgcctatttagcattgaagggccagcgtgtactggcttgggacatcgatgctcagagaatcaaagagattcaggaccgtggagccatcatagcggaaggaccaggacttgctgggactgctcacccggatcttctgacctcagatataggtttggcggttaaagacgctgatgtgatactgattgtagtgccggccatccaccacgcttccattgcagcaaatatcgccagttacatttccgagggtcagttgattatccttaaccctggggcaacgggtggagcgctggaattccggaaaatcctgcgtgaaaatggtgcgccggaggtaacgatcggggaaacctcaagtatgctctttacatgccgctccgagagaccaggacaggttacggtaaatgcgataacacgtgccatggactttgcatgtctcccagcggcaaaagctggatgggccctggaacagatagggtcggttcttcctcaataccaggctgtcgaaaacgtgttgcatacttcgctgactaatatcgaagctgtattgcacccgctgccaacactgttaaacgctgctcgttgtgagtctggtaccccattccattattataccgaggggattacgccatcagtcggggcgcttgcggagaaagtggacgctgaacgcatagcaatcgcaaaggctttcgatttaaacgttccgtcggtctgcgaatggcataagattagttacggccagtcaccggccacaatttatgaagcggtgcagggtaatcctgctctgcgcggcattatgggacctaccagccttaacacggtgcacttcttcgaggatgtaagcaccggactggtaccgttatccgaactgggtcgggcagtgaatgtgcctaccccacttatcgatgctgttcttctgttgatcagttcgctgatagacgtggatttcagaaaggaaggtcgtaccttggaaaaattaggtctgagcggacttaccgccgcggaaataagaagtgctgttgag

SEQ ID NO: 354 - protein, 359 aa, Artificial Sequence
  Engineered variant of opine dehydrogenase CENDH
MIESKTYAVLGLGNGGHAFAAYLALKGQRVLAWDIDAQRIKEIQDRGAIIAEGPGLAGTAHPDLLTSDIGLAVKDADVILIVVPAIHHASIAANIASYISEGQLIILNPGATGGALEFRKILRENGAPEVTIGETSSMLFTCRSERPGQVTVNAITRAMDFACLPAAKAGWALEQIGSVLPQYQAVENVLHTSLTNIEAVLHPLPTLLNAARCESGTPFHYYTEGITPSVGALAEKVDAERIAIAKAFDLNVPSVCEWHKISYGQSPATIYEAVQGNPALRGIMGPTSLNTVHFFEDVSTGLVPLSELGRAVNVPTPLIDAVLLLISSLIDVDFRKEGRTLEKLGLSGLTAAEIRSAVE

SEQ ID NO: 355 - DNA, 1077 bp, Artificial Sequence
  Engineered variant of opine dehydrogenase CENDH
atgatcgagtcaaaaacatacgccgttttgggattaggaaacgggggtcacgcatttgccgcctatttagcattgaagggccagcgtgtactggcttgggacatcgatgctcagagaatcaaagagattcaggaccgtggagccatcatagcggaaggaccaggacttgctgggactgctcacccggatcttctgacctcagatataggtttggcggttaaagacgctgatgtgatactgattgtagtgccggccatccaccacgcttccattgcagcaaatatcgccagttacatttccgagggtcagttgattatccttaaccctggggcaacgggtggagcgctggaattccggaaaatcctgcgtgaaaatggtgcgccggaggtaacgatcggggaaacctcaagtatgctctttacatgccgctccgagagaccaggacaggttacggtaaatgcgataacaatggccatggactttgcatgtctcccagcggcaaaagctggatgggccctggaacagatagggtcggttcttcctcaataccgtgctgtcgaaaacgtgttgcatacttcgctgactaatatcgaagctgtattgcacccgctgccaacactgttaaacgctgctcgttgtgagtctggtaccccattccaatattataccgaggggattacgccatcagtcgggagtcttgcggagaaagtggacgctgaacgcatagcaatcgcaaaggctttcgatttaaacgttccgtcggtctgcgaatggcataaggcgagttacggccagtcaccggccacaatttatgaagcggtgcagggtaatcctgctctgcgcggcattatgggacctaccggccttaacacggtgcacttcttcgaggatgtaagcaccggactggtaccgttatccgaactgggtcgggtggtgaatgtgcctaccccacttatcgatgctgttcttgacttgatcagtggcctgatagacacggatttcagaaaggaaggtcgtaccttggaaaaattaggtctgagcggacttaccgccgcgggcataagaagtgctgttgag

SEQ ID NO: 356 - protein, 359 aa, Artificial Sequence
  Engineered variant of opine dehydrogenase CENDH
MIESKTYAVLGLGNGGHAFAAYLALKGQRVLAWDIDAQRIKEIQDRGAIIAEGPGLAGTAHPDLLTSDIGLAVKDADVILIVVPAIHHASIAANIASYISEGQLIILNPGATGGALEFRKILRENGAPEVTIGETSSMLFTCRSERPGQVTVNAITMAMDFACLPAAKAGWALEQIGSVLPQYRAVENVLHTSLTNIEAVLHPLPTLLNAARCESGTPFQYYTEGITPSVGSLAEKVDAERIAIAKAFDLNVPSVCEWHKASYGQSPATIYEAVQGNPALRGIMGPTGLNTVHFFEDVSTGLVPLSELGRVVNVPTPLIDAVLDLISGLIDTDFRKEGRTLEKLGLSGLTAAGIRSAVE

SEQ ID NO: 357 - DNA, 1077 bp, Artificial Sequence
  Engineered variant of opine dehydrogenase CENDH
atgatcgagtcaaaaacatacgccgttttgggattaggaaacgggggtcacgcatttgccgcctatttagcattgaagggccagcgtgtactggcttgggacatcgatgctcagagaatcaaagagattcaggaccgtggagccatcatagcggaaggaccaggacttgctgggactgctcacccggatcttctgaccgcggatataggtttggcggttaaagacgctgatgtgatactgattgtagtgccggccatccaccacgcttccattgcagcaaatatcgccagttacatttccgagggtcagttgattatccttaaccctggggcaacgggtggagcgctggaattccggaaaatcctgcgtgaaaatggtgcgccggaggtaacgatcggggaaacctcaagtatgctctttacatgccgctccgagagaccaggacaggttacggtaaatgcgataacactggccatggactttgcatgtctcccagcggcaaaagctggatgggccctggaacagatagggtcggttcttcctcaataccgtgctgtcgaaaacgtgttgcatacttcgctgactaatatcgaagctgtattgcacccgctgccaacactgttaaacgctgctcgttgtgagtctggtaccccattccaatattataccgaggggattacgccatcagtcgggagtcttgcggagaaagtggacgctgaacgcatagcaatcgcaaaggctttcgatttaaacgttccgtcggtctgcgaatggcataaggcgagttacggccagtcaccggccacaatttatgaagcggtgcagggtaatcctgctctgcgcggcattatgggacctaccaaccttaacacggtgcacttcttcgaggatgtaagcaccggactggtaccgttatccgaactgggtcgggcagtgaatgtgcctaccccacttatcgatgctgttcttgacttgatcagttcgctgatagacacggatttcagaaaggaaggtcgtaccttggaaaaattaggtctgagcggacttaccgccgcgggcataagaagtgctgttgag

SEQ ID NO: 358 - protein, 359 aa, Artificial Sequence
  Engineered variant of opine dehydrogenase CENDH
MIESKTYAVLGLGNGGHAFAAYLALKGQRVLAWDIDAQRIKEIQDRGAIIAEGPGLAGTAHPDLLTADIGLAVKDADVILIVVPAIHHASIAANIASYISEGQLIILNPGATGGALEFRKILRENGAPEVTIGETSSMLFTCRSERPGQVTVNAITLAMDFACLPAAKAGWALEQIGSVLPQYRAVENVLHTSLTNIEAVLHPLPTLLNAARCESGTPFQYYTEGITPSVGSLAEKVDAERIAIAKAFDLNVPSVCEWHKASYGQSPATIYEAVQGNPALRGIMGPTNLNTVHFFEDVSTGLVPLSELGRAVNVPTPLIDAVLDLISSLIDTDFRKEGRTLEKLGLSGLTAAGIRSAVE

SEQ ID NO: 359 - DNA, 1077 bp, Artificial Sequence
  Engineered variant of opine dehydrogenase CENDH
atgatcgagtcaaaaacatacgccgttttgggattaggaaacgggggtcacgcatttaccgcctatttagcattgaagggccagcgtgtactggcttgggacatcgatgctcagagaatcaaagagattcaggaccgtggagccatcatagcggaaggaccaggacttgctgggactgctcacccggatcttctgacctcagatataggtttggcggttaaagacgctgatgtgatactgattgtagtgccggccatccaccacgcttccattgcagcaaatatcgccagttacatttccgagggtcagttgattatccttaaccctggggcaacgggtggagcgctggaattccggaaaatcctgcgtgaaaatggtgcgccggaggtaacgatcggggaaacctcaagtatgctctttacatgccgctccgagagaccaggactggttacggtaaatgcgataacacatgccatggactttgcatgtctcccagcggcaaaagctggatgggccctggaacagatagggtcggttcttcctcaataccgtgctgtcgaaaacgtgttgcatacttcgctgactaatatcgaagctgtattgcacccgctgccaacactgttaaacgctgctcgttgtgagtctggtaccccattccaatattataccgaggggattacgccatcagtcgggagtcttgcggagaaagtggacgctgaacgcatagcaatcgcaaaggctttcgatttaaacgttccgtcggtctgcgaatggcataagagcagttacggccagtcaccggccacaatttatgaagcggtgcagggtaatcctgctctgcgcggcattatgggacctaccaaccttaacacggtgcacttcttcgaggatgtaagcaccggactggtaccgttatccgaactgggtcgggtggtgaatgtgcctaccccacttatcgatgctgttcttgacttgatcagttcgctgatagacacggatttcagaaaggaaggtcgtaccttggaaaaattaggtctgagcggacttaccgccgcgggcataagaagtgctgttgag

SEQ ID NO: 360 - protein, 359 aa, Artificial Sequence
  Engineered variant of opine dehydrogenase CENDH
MIESKTYAVLGLGNGGHAFTAYLALKGQRVLAWDIDAQRIKEIQDRGAIIAEGPGLAGTAHPDLLTSDIGLAVKDADVILIVVPAIHHASIAANIASYISEGQLIILNPGATGGALEFRKILRENGAPEVTIGETSSMLFTCRSERPGLVTVNAITHAMDFACLPAAKAGWALEQIGSVLPQYRAVENVLHTSLTNIEAVLHPLPTLLNAARCESGTPFQYYTEGITPSVGSLAEKVDAERIAIAKAFDLNVPSVCEWHKSSYGQSPATIYEAVQGNPALRGIMGPTNLNTVHFFEDVSTGLVPLSELGRVVNVPTPLIDAVLDLISSLIDTDFRKEGRTLEKLGLSGLTAAGIRSAVE

SEQ ID NO: 361 - DNA, 1077 bp, Artificial Sequence
  Engineered variant of opine dehydrogenase CENDH
atgatcgagtcaaaaacatacgccgttttgggattaggaaacgggggtcacgcatttaccgcctatttagcattgaagggccagcgtgtactggcttgggacatcgatgctcagagaatcaaagagattcaggaccgtggagccatcatagcggaaggaccaggacttgctgggactgctcacccggatcttctgacctcagatataggtttggcggttaaagacgctgatgtgatactgattgtagtgccggccatccaccacgcttccattgcagcaaatatcgccagttacatttccgagggtcagttgattatccttaaccctggggcaacgggtggagcgctggaattccggaaaatcctgcgtgaaaatggtgcgccggaggtaacgatcggggaaacctcaagtatgctctttacatgccgctccgagagaccaggacaggttacggtaaatgcgataacactggccatggactttgcatgtctcccagcggcaaaagctggatgggccctggaacagatagggtcggttcttcctcaataccgtgctgtcgaaaacgtgttgcatacttcgctgactaatatcgaagctgtattgcacccgctgccaacactgttaaacgctgctcgttgtgagtctggtaccccattccaatattataccgaggggattacgccatcagtcgggagtcttgcggagaaagtggacgctgaacgcatagcaatcgcaaaggctttcgatttaaacgttccgtcggtctgcgaatggcataaggcgagttacggccagtcaccggccacaatttatgaagcggtgcagggtaatcctgctctgcgcggcattatgggacctagcggccttaacacggtgcacttcttcgaggatgtaagcaccggactggtaccgttatccgaactgggtcgggtggtgaatgtgcctaccccacttatcgatgctgttcttgacttgatcagttcgctgatagacacggatttcagaaaggaaggtcgtaccttggaaaaattaggtctgagcggacttaccgccgcgggcataagaagtgctgttgag

SEQ ID NO: 362 - protein, 359 aa, Artificial Sequence
  Engineered variant of opine dehydrogenase CENDH
MIESKTYAVLGLGNGGHAFTAYLALKGQRVLAWDIDAQRIKEIQDRGAIIAEGPGLAGTAHPDLLTSDIGLAVKDADVILIVVPAIHHASIAANIASYISEGQLIILNPGATGGALEFRKILRENGAPEVTIGETSSMLFTCRSERPGQVTVNAITLAMDFACLPAAKAGWALEQIGSVLPQYRAVENVLHTSLTNIEAVLHPLPTLLNAARCESGTPFQYYTEGITPSVGSLAEKVDAERIAIAKAFDLNVPSVCEWHKASYGQSPATIYEAVQGNPALRGIMGPSGLNTVHFFEDVSTGLVPLSELGRVVNVPTPLIDAVLDLISSLIDTDFRKEGRTLEKLGLSGLTAAGIRSAVE

SEQ ID NO: 363 - DNA, 1077 bp, Artificial Sequence
  Engineered variant of opine dehydrogenase CENDH
atgatcgagtcaaaaacatacgccgttttgggattaggaaacgggggtcacgcatttaccgcctatttagcattgaagggccagcgtgtactggcttgggacatcgatgctcagagaatcaaagagattcaggaccgtggagccatcatagcggaaggaccaggacttgctgggactgctcacccggatcttctgacctcagatataggtttggcggttaaagacgctgatgtgatactgattgtagtgccggccatccaccacgcttccattgcagcaaatatcgccagttacatttccgagggtcagttgattatccttaaccctggggcaacgggtggagcgctggaattccggaaaatcctgcgtgaaaatggtgcgccggaggtaacgatcggggaaacctcaagtatgctctttacatgccgctccgagagaccaggactggttacggtaaatgcgataacactggccatggactttgcatgtctcccagcggcaaaagctggatgggccctggaacagatagggtcggttcttcctcaataccgtgctgtcgaaaacgtgttgcatacttcgctgactaatatcgaagctgtattgcacccgctgccaacactgttaaacgctgctcgttgtgagtctggtaccccattccaatattataccgaggggattacgccatcagtcgggagtcttgcggagaaagtggacgctgaacgcatagcaatcgcaaaggctttcgatttaaacgttccgtcggtctgcgaatggcataagaaaagttacggccagtcaccggccacaatttatgaagcggtgcagggtaatcctgctctgcgcggcattatgggacctaccggccttaacacggtgcacttcttcgaggatgtaagcaccggactggtaccgttatccgaactgggtcgggtggtgaatgtgcctaccccacttatcgatgctgttcttgacttgatcagttcgctgatagacacggatttcagaaaggaaggtcgtaccttggaaaaattaggtctgagcggacttaccgccgcgggcataagaagtgctgttgag

SEQ ID NO: 364 - protein, 359 aa, Artificial Sequence
  Engineered variant of opine dehydrogenase CENDH
MIESKTYAVLGLGNGGHAFTAYLALKGQRVLAWDIDAQRIKEIQDRGAIIAEGPGLAGTAHPDLLTSDIGLAVKDADVILIVVPAIHHASIAANIASYISEGQLIILNPGATGGALEFRKILRENGAPEVTIGETSSMLFTCRSERPGLVTVNAITLAMDFACLPAAKAGWALEQIGSVLPQYRAVENVLHTSLTNIEAVLHPLPTLLNAARCESGTPFQYYTEGITPSVGSLAEKVDAERIAIAKAFDLNVPSVCEWHKKSYGQSPATIYEAVQGNPALRGIMGPTGLNTVHFFEDVSTGLVPLSELGRVVNVPTPLIDAVLDLISSLIDTDFRKEGRTLEKLGLSGLTAAGIRSAVE

SEQ ID NO: 365 - DNA, 1077 bp, Artificial Sequence
  Engineered variant of opine dehydrogenase CENDH
atgatcgagtcaaaaacatacgccgttttgggattaggaaacgggggtcacgcatttgccgcctatttagcattgaagggccagcgtgtactggcttgggacatcgatgctcagagaatcaaagagattcaggaccgtggagccatcatagcggaaggaccaggacttgctgggactgctcacccggatcttctgaccgcggatataggtttggcggttaaagacgctgatgtgatactgattgtagtgccggccatccaccacgcttccattgcagcaaatatcgccagttacatttccgagggtcagttgattatccttaaccctggggcaacgggtggagcgctggaattccggaaaatcctgcgtgaaaatggtgcgccggaggtaacgatcggggaaacctcaagtatgctctttacatgccgctccgagagaccaggacaggttacggtaaatgcgataacacgtgccatggactttgcatgtctcccagcggcaaaagctggatgggccctggaacagatagggtcggttcttcctcaataccgtgctgtcgaaaacgtgttgcatacttcgctgactaatatcgaagctgtattgcacccgctgccaacactgttaaacgctgctcgttgtgagtctggtaccccattccaatattataccgaggggattacgccatcagtcgggagtcttgcggagaaagtggacgctgaacgcatagcaatcgcaaaggctttcgatttaaacgttccgtcggtctgcgaatggcataagagcagttacggccagtcaccggccacaatttatgaagcggtgcagggtaatcctgctctgcgcggcattatgggacctaccggccttaacacggtgcacttcttcgaggatgtaagcaccggactggtaccgttatccgaactgggtcgggtggtgaatgtgcctaccccacttatcgatgctgttcttgacttgatcagttcgctgatagacacggatttcagaaaggaaggtcgtaccttggaaaaattaggtctgagcggacttaccgccgcgggcataagacgtgctgttgag

SEQ ID NO: 366 - protein, 359 aa, Artificial Sequence
  Engineered variant of opine dehydrogenase CENDH
MIESKTYAVLGLGNGGHAFAAYLALKGQRVLAWDIDAQRIKEIQDRGAIIAEGPGLAGTAHPDLLTADIGLAVKDADVILIVVPAIHHASIAANIASYISEGQLIILNPGATGGALEFRKILRENGAPEVTIGETSSMLFTCRSERPGQVTVNAITRAMDFACLPAAKAGWALEQIGSVLPQYRAVENVLHTSLTNIEAVLHPLPTLLNAARCESGTPFQYYTEGITPSVGSLAEKVDAERIAIAKAFDLNVPSVCEWHKSSYGQSPATIYEAVQGNPALRGIMGPTGLNTVHFFEDVSTGLVPLSELGRVVNVPTPLIDAVLDLISSLIDTDFRKEGRTLEKLGLSGLTAAGIRRAVE

SEQ ID NO: 367 - DNA, 1077 bp, Artificial Sequence
  Engineered variant of opine dehydrogenase CENDH
atgatcgagtcaaaaacatacgccgttttgggattaggaaacgggggtcacgcatttgccgcctatttagcattgaagggccagcgtgtactggcttgggacatcgatgctcagagaatcaaagagattcaggaccgtggagccatcatagcggaaggaccaggacttgctgggactgctcacccggatcttctgacctcagatataggtttggcggttaaagacgctgatgtgatactgattgtagtgccggccatccaccacgcttccattgcagcaaatatcgccagttacatttccgagggtcagttgattatccttaaccctggggcaacgggtggagcgctggaattccggaaaatcctgcgtgaaaatggtgcgccggaggtaacgatcggggaaacctcaagtatgctctttacatgccgctccgagagaccaggactggttacggtaaatgcgataacactggccatggactttgcatgtctcccagcggcaaaagctggatgggccctggaacagatagggtcggttcttcctcaataccgtgctgtcgaaaacgtgttgcatacttcgctgactaatatcgaagctgtattgcacccgctgccaacactgttaaacgctgctcgttgtgagtctggtaccccattccaatattataccgaggggattacgccatcagtcgggagtcttgcggagaaagtggacgctgaacgcatagcaatcgcaaaggctttcgatttaaacgttccgtcggtctgcgaatggcataaggcgagttacggccagtcaccggccacaatttatgaagcggtgcagggtaatcctgctctgcgcggcattatgggacctaccggccttaacacggtgcacttcttcgaggatgtaagcaccggactggtaccgttatccgaactgggtcgggtggtgaatgtgcctaccccacttatcgatgctgttcttgacttgatcagttcgctgatagacacggatttcagaaaggaaggtcgtaccttggaaaaattaggtctgagcggacttaccgccgcgggcataagacgtgctgttgag

SEQ ID NO: 368 - protein, 359 aa, Artificial Sequence
  Engineered variant of opine dehydrogenase CENDH
MIESKTYAVLGLGNGGHAFAAYLALKGQRVLAWDIDAQRIKEIQDRGAIIAEGPGLAGTAHPDLLTSDIGLAVKDADVILIVVPAIHHASIAANIASYISEGQLIILNPGATGGALEFRKILRENGAPEVTIGETSSMLFTCRSERPGLVTVNAITLAMDFACLPAAKAGWALEQIGSVLPQYRAVENVLHTSLTNIEAVLHPLPTLLNAARCESGTPFQYYTEGITPSVGSLAEKVDAERIAIAKAFDLNVPSVCEWHKASYGQSPATIYEAVQGNPALRGIMGPTGLNTVHFFEDVSTGLVPLSELGRVVNVPTPLIDAVLDLISSLIDTDFRKEGRTLEKLGLSGLTAAGIRRAVE

SEQ ID NO: 369 - DNA, 1077 bp, Artificial Sequence
  Engineered variant of opine dehydrogenase CENDH
atgatcgagtcaaaaacatacgccgttttgggattaggaaacgggggtcacgcatttaccgcctatttagcattgaagggccagcgtgtactggcttgggacatcgatgctcagagaatcaaagagattcaggaccgtggagccatcatagcggaaggaccaggacttgctgggactgctcacccggatcttctgaccgcggatataggtttggcggttaaagacgctgatgtgatactgattgtagtgccggccatccaccacgcttccattgcagcaaatatcgccagttacatttccgagggtcagttgattatccttaaccctggggcaacgggtggagcgctggaattccggaaaatcctgcgtgaaaatggtgcgccggaggtaacgatcggggaaacctcaagtatgctctttacatgccgctccgagagaccaggactggttacggtaaatgcgataacactggccatggactttgcatgtctcccagcggcaaaagctggatgggccctggaacagatagggtcggttcttcctcaataccgtgctgtcgaaaacgtgttgcatacttcgctgactaatatcgaagctgtattgcacccgctgccaacactgttaaacgctgctcgttgtgagtctggtaccccattccaatattataccgaggggattacgccatcagtcgggagtcttgcggagaaagtggacgctgaacgcatagcaatcgcaaaggctttcgatttaaacgttccgtcggtctgcgaatggcataagagcagttacggccagtcaccggccacaatttatgaagcggtgcagggtaatcctgctctgcgcggcattatgggacctagcggccttaacacggtgcacatcttcgaggatgtaagcaccggactggtaccgttatccgaactgggtcgggtggtgaatgtgcctaccccacttatcgatgctgttcttgacttgatcagttcgctgatagacacggatttcagaaaggaaggtcgtaccttggaaaaattaggtctgagcggacttaccgccgcgggcataagaagtgctgttgag

SEQ ID NO: 370 - protein, 359 aa, Artificial Sequence
  Engineered variant of opine dehydrogenase CENDH
MIESKTYAVLGLGNGGHAFTAYLALKGQRVLAWDIDAQRIKEIQDRGAIIAEGPGLAGTAHPDLLTADIGLAVKDADVILIVVPAIHHASIAANIASYISEGQLIILNPGATGGALEFRKILRENGAPEVTIGETSSMLFTCRSERPGLVTVNAITLAMDFACLPAAKAGWALEQIGSVLPQYRAVENVLHTSLTNIEAVLHPLPTLLNAARCESGTPFQYYTEGITPSVGSLAEKVDAERIAIAKAFDLNVPSVCEWHKSSYGQSPATIYEAVQGNPALRGIMGPSGLNTVHIFEDVSTGLVPLSELGRVVNVPTPLIDAVLDLISSLIDTDFRKEGRTLEKLGLSGLTAAGIRSAVE

SEQ ID NO: 371 - DNA, 1077 bp, Artificial Sequence
  Engineered variant of opine dehydrogenase CENDH
atgatcgagtcaaaaacatacgccgttttgggattaggaaacgggggtcacgcatttgccgcctatttagcattgaagggccagcgtgtactggcttgggacatcgatgctcagagaatcaaagagattcaggaccgtggagccatcatagcggaaggaccaggacttgctgggactgctcacccggatcttctgaccgcggatataggtttggcggttaaagacgctgatgtgatactgattgtagtgccggccatccaccacgcttccattgcagcaaatatcgccagttacatttccgagggtcagttgattatccttaaccctggggcaacgggtggagcgctggaattccggaaaatcctgcgtgaaaatggtgcgccggaggtaacgatcggggaaacctcaagtatgctctttacatgccgctccgagagaccaggacaggttacggtaaatgcgataacacgtgccatggactttgcatgtctcccagcggcaaaagctggatgggccctggaacagatagggtcggttcttcctcaataccgtgctgtcgaaaacgtgttgcatacttcgctgactaatatcgaagctgtattgcacccgctgccaacactgttaaacgctgctcgttgtgagtctggtaccccattccaatattataccgaggggattacgccatcagtcgggagtcttgcggagaaagtggacgctgaacgcatagcaatcgcaaaggctttcgatttaaacgttccgtcggtctgcgaatggcataaggcgagttacggccagtcaccggccacaatttatgaagcggtgcagggtaatcctgctctgcgcggcatttatggacctaccaaccttaacacggtgcacttcttcgaggatgtaagcaccggactggtaccgttatccgaactgggtcgggtggtgaatgtgcctaccccacttatcgatgctgttcttgacttgatcagtggcctgatagacacggatttcagaaaggaaggtcgtaccttggaaaaattaggtctgagcggacttaccgccgcgggcataagacgtgctgttgag

SEQ ID NO: 372 - protein, 359 aa, Artificial Sequence
  Engineered variant of opine dehydrogenase CENDH
MIESKTYAVLGLGNGGHAFAAYLALKGQRVLAWDIDAQRIKEIQDRGAIIAEGPGLAGTAHPDLLTADIGLAVKDADVILIVVPAIHHASIAANIASYISEGQLIILNPGATGGALEFRKILRENGAPEVTIGETSSMLFTCRSERPGQVTVNAITRAMDFACLPAAKAGWALEQIGSVLPQYRAVENVLHTSLTNIEAVLHPLPTLLNAARCESGTPFQYYTEGITPSVGSLAEKVDAERIAIAKAFDLNVPSVCEWHKASYGQSPATIYEAVQGNPALRGIYGPTNLNTVHFFEDVSTGLVPLSELGRVVNVPTPLIDAVLDLISGLIDTDFRKEGRTLEKLGLSGLTAAGIRRAVE

SEQ ID NO: 373 - DNA, 1077 bp, Artificial Sequence
  Engineered variant of opine dehydrogenase CENDH
atgatcgagtcaaaaacatacgccgttttgggattaggaaacgggggtcacgcatttgccgcctatttagcattgaagggccagcgtgtactggcttgggacatcgatgctcagagaatcaaagagattcaggaccgtggagccatcatagcggaaggaccaggacttgctgggactgctcacccggatcttctgacctcagatataggtttggcggttaaagacgctgatgtgatactgattgtagtgccggccatccaccacgcttccattgcagcaaatatcgccagttacatttccgagggtcagttgattatccttaaccctggggcaacgggtggagcgctggaattccggaaaatcctgcgtgaaaatggtgcgccggaggtaacgatcggggaaacctcaagtatgctctttacatgccgctccgagagaccaggacaggttacggtaaatgcgataacacgtgccatggactttgcatgtctcccagcggcaaaagctggatgggccctggaacagatagggtcggttcttcctcaataccgtgctgtcgaaaacgtgttgcatacttcgctgactaatatcgaagctgtattgcacccgctgccaacactgttaaacgctgctcgttgtgagtctggtaccccattccaatattataccgaggggattacgccatcagtcgggagtcttgcggagaaagtggacgctgaacgcatagcaatcgcaaaggctttcgatttaaacgttccgtcggtctgcgaatggcataagagcagttacggccagtcaccggccacaatttatgaagcggtgcagggtaatcctgctctgcgcggcattctgggacctaccaaccttaacacggtgcacttcttcgaggatgtaagcaccggactggtaccgttatccgaactgggtcgggtggtgaatgtgcctaccccacttatcgatgctgttcttgacttgatcagttcgctgatagacacggatttcagaaaggaaggtcgtaccttggaaaaattaggtctgagcggacttaccgccgcgggcataagaagtgctgttgag

SEQ ID NO: 374 - protein, 359 aa, Artificial Sequence
  Engineered variant of opine dehydrogenase CENDH
MIESKTYAVLGLGNGGHAFAAYLALKGQRVLAWDIDAQRIKEIQDRGAIIAEGPGLAGTAHPDLLTSDIGLAVKDADVILIVVPAIHHASIAANIASYISEGQLIILNPGATGGALEFRKILRENGAPEVTIGETSSMLFTCRSERPGQVTVNAITRAMDFACLPAAKAGWALEQIGSVLPQYRAVENVLHTSLTNIEAVLHPLPTLLNAARCESGTPFQYYTEGITPSVGSLAEKVDAERIAIAKAFDLNVPSVCEWHKSSYGQSPATIYEAVQGNPALRGILGPTNLNTVHFFEDVSTGLVPLSELGRVVNVPTPLIDAVLDLISSLIDTDFRKEGRTLEKLGLSGLTAAGIRSAVE

SEQ ID NO: 375 - DNA, 1077 bp, Artificial Sequence
  Engineered variant of opine dehydrogenase CENDH
atgatcgagtcaaaaacatacgccgttttgggattaggaaacgggggtcacgcatttgccgcctatttagcattgaagggccagcgtgtactggcttgggacatcgatgctcagagaatcaaagagattcaggaccgtggagccatcatagcggaaggaccaggacttgctgggactgctcacccggatcttctgacctcagatataggtttggcggttaaagacgctgatgtgatactgattgtagtgccggccatccaccacgcttccattgcagcaaatatcgccagttacatttccgagggtcagttgattatccttaaccctggggcaacgggtggagcgctggaattccggaaaatcctgcgtgaaaatggtgcgccggaggtaacgatcggggaaacctcaagtatgctctttacatgccgctccgagagaccaggactggttacggtaaatgcgataacactggccatggactttgcatgtctcccagcggcaaaagctggatgggccctggaacagatagggtcggttcttcctcaataccgtgctgtcgaaaacgtgttgcatacttcgctgactaatatcgaagctgtattgcacccgctgccaacactgttaaacgctgctcgttgtgagtctggtaccccattccaatattataccgaggggattacgccatcagtcgggagtcttgcggagaaagtggacgctgaacgcatagcaatcgcaaaggctttcgatttaaacgttccgtcggtctgcgaatggcataagagcagttacggccagtcaccggccacaatttatgaagcggtgcagggtaatcctgctctgcgcggcattatgggacctaccggccttaacacggtgcacttcttcgaggatgtaagcaccggactggtaccgttatccgaactgggtcgggtggtgaatgtgcctaccccacttatcgatgctgttcttgacttgatcagtggcctgatagacacggatttcagaaaggaaggtcgtaccttggaaaaattaggtctgagcggacttaccgccgcgggcataagaagtgctgttgag

SEQ ID NO: 376 - protein, 359 aa, Artificial Sequence
  Engineered variant of opine dehydrogenase CENDH
MIESKTYAVLGLGNGGHAFAAYLALKGQRVLAWDIDAQRIKEIQDRGAIIAEGPGLAGTAHPDLLTSDIGLAVKDADVILIVVPAIHHASIAANIASYISEGQLIILNPGATGGALEFRKILRENGAPEVTIGETSSMLFTCRSERPGLVTVNAITLAMDFACLPAAKAGWALEQIGSVLPQYRAVENVLHTSLTNIEAVLHPLPTLLNAARCESGTPFQYYTEGITPSVGSLAEKVDAERIAIAKAFDLNVPSVCEWHKSSYGQSPATIYEAVQGNPALRGIMGPTGLNTVHFFEDVSTGLVPLSELGRVVNVPTPLIDAVLDLISGLIDTDFRKEGRTLEKLGLSGLTAAGIRSAVE

SEQ ID NO: 377 - DNA, 1077 bp, Artificial Sequence
  Engineered variant of opine dehydrogenase CENDH
atgatcgagtcaaaaacatacgccgttttgggattaggaaacgggggtcacgcatttgccgcctatttagcattgaagggccagcgtgtactggcttgggacatcgatgctcagagaatcaaagagattcaggaccgtggagccatcatagcggaaggaccaggacttgctgggactgctcacccggatcttctgacctcagatataggtttggcggttaaagacgctgatgtgatactgattgtagtgccggccatccaccacgcttccattgcagcaaatatcgccagttacatttccgagggtcagttgattatccttaaccctggggcaacgggtggagcgctggaattccggaaaatcctgcgtgaaaatggtgcgccggaggtaacgatcggggaaacctcaagtatgctctttacatgccgctccgagagaccaggacaggttacggtaaatgcgataacaggcgccatggactttgcatgtctcccagcggcaaaagctggatgggccctggaacagatagggagcgttcttcctcaataccgtgctgtcgaaaacgtgttgcatacttcgctgactaatatcgaagctgtattgcacccgctgccaacactgttaaacgctgctcgttgtgagtctggtaccccattccaatattataccgaggggattacgccatcagtcgggagtcttgcggagaaagtggacgctgaacgcatagcaatcgcaaaggctttcgatttaaacgttccgtcggtctgcgaatggcataagagcagttacggccagtcaccggccacaatttatgaagcggtgcagggtaatcctgctctgcgcggcattatgggacctaccaaccttaacacggtgcacttcttcgaggatgtaagcaccggactggtaccgttatccgaactgggtcgggtggtgaatgtgcctaccccacttatcgatgctgttcttgacttgatcagttcgctgatagacacggatttcagaaaggaaggtcgtaccttggaaaaattaggtctgagcggacttaccgccgcggaaataagaagtgctgttgag

SEQ ID NO: 378 - protein, 359 aa, Artificial Sequence
  Engineered variant of opine dehydrogenase CENDH
MIESKTYAVLGLGNGGHAFAAYLALKGQRVLAWDIDAQRIKEIQDRGAIIAEGPGLAGTAHPDLLTSDIGLAVKDADVILIVVPAIHHASIAANIASYISEGQLIILNPGATGGALEFRKILRENGAPEVTIGETSSMLFTCRSERPGQVTVNAITGAMDFACLPAAKAGWALEQIGSVLPQYRAVENVLHTSLTNIEAVLHPLPTLLNAARCESGTPFQYYTEGITPSVGSLAEKVDAERIAIAKAFDLNVPSVCEWHKSSYGQSPATIYEAVQGNPALRGIMGPTNLNTVHFFEDVSTGLVPLSELGRVVNVPTPLIDAVLDLISSLIDTDFRKEGRTLEKLGLSGLTAAEIRSAVE

SEQ ID NO: 379 - DNA, 1077 bp, Artificial Sequence
  Engineered variant of opine dehydrogenase CENDH
atgatcgagtcaaaaacatacgccgttttgggattaggaaacgggggtcacgcatttgccgcctatttagcattgaagggccagcgtgtactggcttgggacatcgatgcgcagagaatcaaagagattcaggaccgtggagccatcatagcggaaggaccaggacttgctgggactgctcacccggatcttctgacctcagatataggtttggcggttaaagacgctgatgtgatactgattgtagtgccggccatccaccacgcttccattgcagcaaatatcgccagctacatttccgagggtcagttgattatccttaaccctggggcaacgggtggagcgctggaattccggaaaatcctgcgtgaaaatggtgcgccggaggtaacgatcggggaaacctcaagtatgctctttacatgccgctccgagagaccaggacaggttacggtaaatgcgataacaggcgccatggactttgcatgtctcccagcggcaaaagctggatgggccctggaacagatagggtcggttcttcctcaataccgtgctgtcgaaaacgtgttgcatacttcgctgactaatatcgaagctgtattgcacccgctgccaacactgttaaacgctgctcgttgtgagtctggtaccccattccaatattataccgaggggattacgccatcagtcgggagtcttgcggagaaagtggacgctgaacgcatagcaatcgcaaaggctttcgatttaaacgttccgtcggtctgcgaatggcataagagcagttacggccagtcaccggccacaatttatgaagcggtgcagggtaatcctgctctgcgcggcattatgggacctaccaaccttaacacggtgcacttcttcgaggatgtaagcaccggactggtaccgttatccgaactgggtcgggtggtgaatgtgcctaccccacttatcgatgctgttcttgacttgatcagttcgctgatagacacggatttcagaaaggaaggtcgtaccttggaaaaattaggtctgagcggacttaccgccgcgggcataagaagtgctgttgag

SEQ ID NO: 380 - protein, 359 aa, Artificial Sequence
  Engineered variant of opine dehydrogenase CENDH
MIESKTYAVLGLGNGGHAFAAYLALKGQRVLAWDIDAQRIKEIQDRGAIIAEGPGLAGTAHPDLLTSDIGLAVKDADVILIVVPAIHHASIAANIASYISEGQLIILNPGATGGALEFRKILRENGAPEVTIGETSSMLFTCRSERPGQVTVNAITGAMDFACLPAAKAGWALEQIGSVLPQYRAVENVLHTSLTNIEAVLHPLPTLLNAARCESGTPFQYYTEGITPSVGSLAEKVDAERIAIAKAFDLNVPSVCEWHKSSYGQSPATIYEAVQGNPALRGIMGPTNLNTVHFFEDVSTGLVPLSELGRVVNVPTPLIDAVLDLISSLIDTDFRKEGRTLEKLGLSGLTAAGIRSAVE

SEQ ID NO: 381 - DNA, 1077 bp, Artificial Sequence
  Engineered variant of opine dehydrogenase CENDH
atgatcgagtcaaaaacatacgccgttttgggattaggaaacgggggtcacgcatttgccgcctatttagcattgaagggccagcgtgtactggcttgggacatcgatgctcagagaatcaaagagattcaggaccgtggagccatcatagcggaaggaccaggacttgctgggactgctcacccggatcttctgacctcagatataggtttggcggttaaagacgctgatgtgatactgattgtagtgccggccatccaccacgcttccattgcagcaaatatcgccagttacatttccgagggtcagttgattatccttaaccctggggcaacgggtggagcgctggaattccggaaaatcctgcgtgaaaatggtgcgccggaggtaacgatcggggaaacctcaagtatgctctttacatgccgctccgagagaccaggacaggttacggtaaatgcgataacaggcgccatggactttgcatgtctcccagcggcaaaagctggatgggccctggaacagatagggtcggttcttcctcaataccgtgctgtcgaaaacgtgttgcatacttcgctgactaatatcgaagctgtattgcacccgctgccaacactgttaaacgctgctcgttgtgagtctggtaccccattccaatattataccgaggggattacgccatcagtcgggagtcttgcggagaaagtggacgctgaacgcatagcaatcgcaaaggctttcgatttaaacgttccgtcggtctgcgaatggcataagagcagttacggcttgtcaccggccacaatttatgaagcggtgcagggtaatcctgctctgcgcggcattatgggacctaccaaccttaacacggtgcacttcttcgaggatgtaagcaccggactggtaccgttatccgaactgggtcgggcagtgaatgtgcctaccccacttatcgatgctgttcttgacttgatcagttcgctgatagacacggatttcagaaaggaaggtcgtaccttggaaaaattaggtctgagcggacttaccgccgcgggcataagaagtgctgttgag

SEQ ID NO: 382 - protein, 359 aa, Artificial Sequence
  Engineered variant of opine dehydrogenase CENDH
MIESKTYAVLGLGNGGHAFAAYLALKGQRVLAWDIDAQRIKEIQDRGAIIAEGPGLAGTAHPDLLTSDIGLAVKDADVILIVVPAIHHASIAANIASYISEGQLIILNPGATGGALEFRKILRENGAPEVTIGETSSMLFTCRSERPGQVTVNAITGAMDFACLPAAKAGWALEQIGSVLPQYRAVENVLHTSLTNIEAVLHPLPTLLNAARCESGTPFQYYTEGITPSVGSLAEKVDAERIAIAKAFDLNVPSVCEWHKSSYGLSPATIYEAVQGNPALRGIMGPTNLNTVHFFEDVSTGLVPLSELGRAVNVPTPLIDAVLDLISSLIDTDFRKEGRTLEKLGLSGLTAAGIRSAVE

SEQ ID NO: 383 - DNA, 1077 bp, Artificial Sequence
  Engineered variant of opine dehydrogenase CENDH
atgatcgagtcaaaaacatacgccgttttgggattaggaaacgggggtcacgcatttgccgcctatttagcattgaagggccagcgtgtactggcttgggacatcgatgctcagagaatcaaagagattcaggaccgtggagccatcatagcggaaggaccaggacttgctgggactgctcacccggatcttctgacctcagatataggtttggcggttaaagacgctgatgtgatactgattgtagtgccggccatccaccacgcttccattgcagcaaatatcgccagttacatttccgagggtcagttgattatccttaaccctggggcaacgggtggagcgctggaattccggaaaatcctgcgtgaaaatggtgcgccggaggtaacgatcggggaaacctcaagtatgctctttacatgccgctccgagagaccaggacaggttacggtaaatgcgataacaggcgccatggactttgcatgtctcccagcggcaaaagctggatgggccctggaacagatagggtcggttcttcctcaataccgtgctgtcgaaaacgtgttgcatacttcgctgactaatatcgaagctgtattgcacccgctgccaacactgttaaacgctgctcgttgtgagtctggtaccccattccaatattataccgaggggattacgccatcagtcgggagtcttgcggagaaagtggacgctgaacgcatagcaatcgcaaaggctttcgatttaaacgttccgtcggtctgcgaatggcataagagcagttacggccagtcaccggccacaatttatgaagcggtgcagggtaatcctgctctgcgcggcattatgggacctaccaaccttaacacggtgcacttcttcgaggatgtaagcaccggactggtaccgttatccgaactgggtcgggcagtgaatgtgcctaccccacttatcgatgctgttcttgacttgatcagttcgctgatagacacggatttcagaaaggaaggtcgtaccttggaaaaattaggtctgagcggacttaccgccgcgggcataagaagtgctgttctt

SEQ ID NO: 384 - protein, 359 aa, Artificial Sequence
  Engineered variant of opine dehydrogenase CENDH
MIESKTYAVLGLGNGGHAFAAYLALKGQRVLAWDIDAQRIKEIQDRGAIIAEGPGLAGTAHPDLLTSDIGLAVKDADVILIVVPAIHHASIAANIASYISEGQLIILNPGATGGALEFRKILRENGAPEVTIGETSSMLFTCRSERPGQVTVNAITGAMDFACLPAAKAGWALEQIGSVLPQYRAVENVLHTSLTNIEAVLHPLPTLLNAARCESGTPFQYYTEGITPSVGSLAEKVDAERIAIAKAFDLNVPSVCEWHKSSYGQSPATIYEAVQGNPALRGIMGPTNLNTVHFFEDVSTGLVPLSELGRAVNVPTPLIDAVLDLISSLIDTDFRKEGRTLEKLGLSGLTAAGIRSAVL

SEQ ID NO: 385 - DNA, 1077 bp, Artificial Sequence
  Engineered variant of opine dehydrogenase CENDH
atgatcgagtcaaaaacatacgccgttttgggattaggaaacgggggtcacgcatttgccgcctatttagcattgaagggccagcgtgtactggcttgggacatcgatgctcagagaatcaaagagattcaggaccgtggagccatcatagcggaaggaccaggacttgctgggactgctcacccggatcttctgacctcagatataggtttggcggttaaagacgctgatgtgatactgattgtagtgccggccatccaccacgcttccattgcagcaaatatcgccagttacatttccgagggtcagttgattatccttaaccctggggcaacgggtggagcgctggaattccggaaaatcctgcgtgaaaatggtgcgccggaggtaacgatcggggaaacctcaagtatgctctttacatgccgctccgagagaccaggacaggttacggtaaatgcgataacaggcgccatggactttgcatgtctcccagcggcaaaagctggatgggccctggaacagatagggtcggttcttcctcaataccgtgctgtcgaaaacgtgttgcatacttcgctgactaatatcgaagctgtattgcacccgctgccaacactgttaaacgctgctcgttgtgagtctggtaccccattccaatattataccgaggggattacgccatcagtcgggagtcttgcggagaaagtggacgctgaacgcatagcaatcgcaaaggctttcgatttaaacgttccgtcggtctgcgaatggcataagagcagttacggctattcaccggccacaatttatgaagcggtgcagggtaatcctgctctgcgcggcattatgggacctaccaaccttaacacggtgcacttcttcgaggatgtaagcaccggactggtaccgttatccgaactgggtcgggcagtgaatgtgcctaccccacttatcgatgctgttcttgacttgatcagttcgctgatagacacggatttcagaaaggaaggtcgtaccttggaaaaattaggtctgagcggacttaccgccgcgggcataagaagtgctgttgag

SEQ ID NO: 386 - protein, 359 aa, Artificial Sequence
  Engineered variant of opine dehydrogenase CENDH
MIESKTYAVLGLGNGGHAFAAYLALKGQRVLAWDIDAQRIKEIQDRGAIIAEGPGLAGTAHPDLLTSDIGLAVKDADVILIVVPAIHHASIAANIASYISEGQLIILNPGATGGALEFRKILRENGAPEVTIGETSSMLFTCRSERPGQVTVNAITGAMDFACLPAAKAGWALEQIGSVLPQYRAVENVLHTSLTNIEAVLHPLPTLLNAARCESGTPFQYYTEGITPSVGSLAEKVDAERIAIAKAFDLNVPSVCEWHKSSYGYSPATIYEAVQGNPALRGIMGPTNLNTVHFFEDVSTGLVPLSELGRAVNVPTPLIDAVLDLISSLIDTDFRKEGRTLEKLGLSGLTAAGIRSAVE

SEQ ID NO: 387 - DNA, 1077 bp, Artificial Sequence
  Engineered variant of opine dehydrogenase CENDH
atgatcgagtcaaaaacatacgccgttttgggattaggaaacgggggtcacgcatttgccgcctatttagcattgaagggccagcgtgtactggcttgggacatcgatgctcagagaatcaaagagattcaggaccgtggagccatcatagcggaaggaccaggacttgctgggactgctcacccggatcttctgacctcagatataggtttggcggttaaagacgctgatgtgatactgattgtagtgccggccatccaccacgcttccattgcagcaactatcgccagttacatttccgagggtcagttgattatccttaaccctggggcaacgggtggagcgctggaattccggaaaatcctgcgtgaaaatggtgcgccggaggtaacgatcggggaaacctcaagtatgctctttacatgccgctccgagagaccaggacaggttacggtaaatgcgataacaggcgccatggactttgcatgtctcccagcggcaaaagctggatgggccctggaacagatagggtcggttcttcctcaataccgtgctgtcgaaaacgtgttgcatacttcgctgactaatatcgaagctgtattgcacccgctgccaacactgttaaacgctgctcgttgtgagtctggtaccccattccaatattataccgaggggattacgccatcagtcgggagtcttgcggagaaagtggacgctgaacgcatagcaatcgcaaaggctttcgatttaaacgttccgtcggtctgcgaatggcataagagcagttacggccagtcaccggccacaatttatgaagcggtgcagggtaatcctgctctgcgcggcattatgggacctaccaaccttaacacggtgcacttcttcgaggatgtaagcaccggactggtaccgttatccgaactgggtcgggcagtgaatgtgcctaccccacttatcgatgctgttcttgacttgatcagttcgctgatagacacggatttcagaaaggaaggtcgtaccttggaaaaattaggtctgagcggacttaccgccgcgggcataagaagtgctgttgag

SEQ ID NO: 388 - protein, 359 aa, Artificial Sequence
  Engineered variant of opine dehydrogenase CENDH
MIESKTYAVLGLGNGGHAFAAYLALKGQRVLAWDIDAQRIKEIQDRGAIIAEGPGLAGTAHPDLLTSDIGLAVKDADVILIVVPAIHHASIAATIASYISEGQLIILNPGATGGALEFRKILRENGAPEVTIGETSSMLFTCRSERPGQVTVNAITGAMDFACLPAAKAGWALEQIGSVLPQYRAVENVLHTSLTNIEAVLHPLPTLLNAARCESGTPFQYYTEGITPSVGSLAEKVDAERIAIAKAFDLNVPSVCEWHKSSYGQSPATIYEAVQGNPALRGIMGPTNLNTVHFFEDVSTGLVPLSELGRAVNVPTPLIDAVLDLISSLIDTDFRKEGRTLEKLGLSGLTAAGIRSAVE

SEQ ID NO: 389 - DNA, 1077 bp, Artificial Sequence
  Engineered variant of opine dehydrogenase CENDH
atgatcgagtcaaaaacatacgccgttttgggattaggaaacgggggtcacgcatttgccgcctatttagcattgaagggccagcgtgtactggcttgggacatcgatgctcagagaatcaaagagattcaggaccgtggagccatcatagcggaaggaccaggacttgctgggactgctcacccggatcttctgacctcagatataggtttggcggttaaagacgctgatgtgatactgattgtagtgccggccatccaccacgcttccattgcagcaaatatcgccagttacatttccgagggtcagttgattatccttaaccctggggcaacgggtggagcgctggaattccggaaaatcctgcgtgaaaatggtgcgccggaggtaacaatcggggaaacctcaagtatgctctttacatgccgctccgagagaccaggacaggttacggtaaatgcgataacaggcgccatggactttgcatgtctcccagcggcaaaagctggatgggccctggaacagatagggtcggttcttcctcaataccgtgctgtcgaaaacgtgttgcatacttcgctgactaatatcgaagctgtattgcacccgctgccaacactgttaaacgctgctcgttgtgagtctggtaccccattccaatattataccgaggggattacgccatcagtcgggagtcttgcggagaaagtggacgctgaacgcatagcaatcgcaaaggctttcgatttaaacgttccgtcggtctgcgaatggcataagagcagttacggccagtcaccggccacaatttatgaagcggtgcagggtaatcctgctctgcgcggcattatgggacctaccaaccttaacacggtgcacttcttcgaggatgtaagcaccggactggtaccgttatccgaactgggtcgggcagtgaatgtgcctaccccacttatcgatgctgttcttgacttgatcagttcgctgatagacacggatttcagaaaggaaggtcgtaccttggaaaaattaggtctgagcggacttaccgccgcgggcataagaagtgctgttgag

SEQ ID NO: 390 - protein, 359 aa, Artificial Sequence; identical to SEQ ID NO: 252
  Engineered variant of opine dehydrogenase CENDH

SEQ ID NO: 391 - DNA, 1077 bp, Artificial Sequence
  Engineered variant of opine dehydrogenase CENDH
atgatcgagtcaaaaacatacgccgttttgggattaggaaacgggggtcacgcatttgccgcctatttagcattgaagggccagcgtgtactggcttgggacatcgatgctcagagaatcaaagagattcaggaccgtggagccatcatagcggaaggaccaggacttgctgggactgctcacccggatcttctgacctcagatataggtttggcggttaaagacgctgatgtgatactgattgtagtgccggccatccaccacgcttccattgcagcaaatatcgccagttacatttccgagggtcagttgattatccttaaccctggggcaacgggtggagcgctggaattccggaaaatcctgcgtgaaaatggtgcgccggaggtaacgatcggggaaacctcaagtatgctctttacatgccgctccgagagaccaggacaggttacggtaaatgcgataacaggcgccatggactttgcatgtctcccagcggcaaaagctggatgggccctggaacagatagggtcggttcttcctcaataccgtgctgtcgaaaacgtgttgcatacttcgctgactaatatcgaagctgtattgcacccgctgccaacactgttaaacgctgctcgttgtgagtctggtaccccattccaatattataccgaggggattacgccatcagtcgggagtcttgcggagaaagtggacgctgaacgcatagcaatcgcaaaggctttcgatttaaacgttccgtcggtctgcgaatggcataagagcagttacggccagtcaccggccacaatttatgaagcggtgcagggtaatcctgctctgcgcggcattatgggacctaccaaccttaacacggtgcacttcttcgaggatgtaagcaccggactggtaccgttatccgaatttggtcgggcagtgaatgtgcctaccccacttatcgatgctgttcttgacttgatcagttcgctgatagacacggatttcagaaaggaaggtcgtaccttggaaaaattaggtctgagcggacttaccgccgcgggcataagaagtgctgttgag

SEQ ID NO: 392 - protein, 359 aa, Artificial Sequence
  Engineered variant of opine dehydrogenase CENDH
MIESKTYAVLGLGNGGHAFAAYLALKGQRVLAWDIDAQRIKEIQDRGAIIAEGPGLAGTAHPDLLTSDIGLAVKDADVILIVVPAIHHASIAANIASYISEGQLIILNPGATGGALEFRKILRENGAPEVTIGETSSMLFTCRSERPGQVTVNAITGAMDFACLPAAKAGWALEQIGSVLPQYRAVENVLHTSLTNIEAVLHPLPTLLNAARCESGTPFQYYTEGITPSVGSLAEKVDAERIAIAKAFDLNVPSVCEWHKSSYGQSPATIYEAVQGNPALRGIMGPTNLNTVHFFEDVSTGLVPLSEFGRAVNVPTPLIDAVLDLISSLIDTDFRKEGRTLEKLGLSGLTAAGIRSAVE

SEQ ID NO: 393 - DNA, 1077 bp, Artificial Sequence
  Engineered variant of opine dehydrogenase CENDH
atgatcgagtcaaaaacatacgccgttttgggattaggaaacgggggtcacgcatttgccgcctatttagcattgaagggccagcgtgtactggcttgggacatcgatgctcagagaatcaaagagattcaggaccgtggagccatcatagcggaaggaccaggacttgctgggactgctcacccggatcttctgacctcagatataggtttggcggttaaagacgctgatgtgatactgattgtagtgccggccatccaccacgcttccattgcagcacgtatcgccagttacatttccgagggtcagttgattatccttaaccctggggcaacgggtggagcgctggaattccggaaaatcctgcgtgaaaatggtgcgccggaggtaacgatcggggaaacctcaagtatgctctttacatgccgctccgagagaccaggacaggttacggtaaatgcgataacaggcgccatggactttgcatgtctcccagcggcaaaagctggatgggccctggaacagatagggtcggttcttcctcaataccgtgctgtcgaaaacgtgttgcatacttcgctgactaatatcgaagctgtattgcacccgctgccaacactgttaaacgctgctcgttgtgagtctggtaccccattccaatattataccgaggggattacgccatcagtcgggagtcttgcggagaaagtggacgctgaacgcatagcaatcgcaaaggctttcgatttaaacgttccgtcggtctgcgaatggcataagagcagttacggccagtcaccggccacaatttatgaagcggtgcagggtaatcctgctctgcgcggcattatgggacctaccaaccttaacacggtgcacttcttcgaggatgtaagcaccggactggtaccgttatccgaactgggtcgggcagtgaatgtgcctaccccacttatcgatgctgttcttgacttgatcagttcgctgatagacacggatttcagaaaggaaggtcgtaccttggaaaaattaggtctgagcggacttaccgccgcgggcataagaagtgctgttgag

SEQ ID NO: 394 - protein, 359 aa, Artificial Sequence
  Engineered variant of opine dehydrogenase CENDH
MIESKTYAVLGLGNGGHAFAAYLALKGQRVLAWDIDAQRIKEIQDRGAIIAEGPGLAGTAHPDLLTSDIGLAVKDADVILIVVPAIHHASIAARIASYISEGQLIILNPGATGGALEFRKILRENGAPEVTIGETSSMLFTCRSERPGQVTVNAITGAMDFACLPAAKAGWALEQIGSVLPQYRAVENVLHTSLTNIEAVLHPLPTLLNAARCESGTPFQYYTEGITPSVGSLAEKVDAERIAIAKAFDLNVPSVCEWHKSSYGQSPATIYEAVQGNPALRGIMGPTNLNTVHFFEDVSTGLVPLSELGRAVNVPTPLIDAVLDLISSLIDTDFRKEGRTLEKLGLSGLTAAGIRSAVE

SEQ ID NO: 395 - DNA, 1077 bp, Artificial Sequence
  Engineered variant of opine dehydrogenase CENDH
atgatcgagtcaaaaacatatgccgttttgggattaggaaacgggggtcacgcatttgccgcctatttagcattgaagggccagcgtgtactggcttgggacatcgatgctcagagaatcaaagagattcaggaccgtggagccatcatagcggaaggaccaggacttgctgggactgctcacccggatcttctgacctcagatataggtttggcggttaaagacgctgatgtgatactgattgtagtgccggccatccaccacgcttccattgcagcaaatatcgccagttacatttccgagggtcagttgattatccttaaccctggggcaacgggtggagcgctggaattccggaaaatcctgcgtgaaaatggtgcgccggaggtaacgatcggggaaacctcaagtatgctctttacatgccgctccgagagaccaggacaggttacggtaaatgcgataacaggcgccatggactttgcatgtctcccagcggcaaaagctggatgggccctggaacagatagggtcggttcttcctcaataccgtgctgtcgaaaacgtgttgcatacttcgctgactaatatcgaagctgtattgcacccgctgccaacactgttaaacgctgctcgttgtgagtctggtaccccattccaatattataccgaggggattacgccatcagtcgggagtcttgcggagaaagtggacgctgaacgcatagcaatcgcaaaggctttcgatttaaacgttccgtcggtctgcgaatggcataagagcagttacggccagtcaccggccacaatttatgaagcggtgcagggtaatcctgctctgcgcggcattatgggacctaccaaccttaacacggtgcacttcttcgaggatgtaagcaccggactggtaccgttatccgaactgggtcgggcagtgaatgtgcctaccccacttatcgatgctgttcttgacttgatcagttcgctgatagacacggatttcagaaaggaaggtcgtaccttggaaaaattaggtctgagcggacttaccgccgcgggcataagaagtgctgttgag

SEQ ID NO: 396 - protein, 359 aa, Artificial Sequence; identical to SEQ ID NO: 252
  Engineered variant of opine dehydrogenase CENDH

SEQ ID NO: 397 - DNA, 1077 bp, Artificial Sequence
  Engineered variant of opine dehydrogenase CENDH
atgatcgagtcaaaaacatacgccgttttgggattaggaaacgggggtcacgcatttgccgcctatttagcattgaagggccagcgtgtactggcttgggacatcgatgctcagagaatcaaagagattcaggaccgtggagccatcatagcggaaggaccaggacttgctgggactgctcacccggatcttctgacctcagatataggtttggcggttaaagacgctgatgtgatactgattgtagtgccggccatccaccacgcttccattgcagcaaatatcgccagttacatttccgagggtcagttgattatccttaaccctggggcaacgggtggagcgctggaattccggaaaatcctgcgtgaaaatggtgcgccggaggtaacgatcggggaaacctcaagtatgctctttacatgccgctccgagagaccaggacaggttacggtaaatgcgataacaggcgccatggactttgcatgtctcccagcggcaaaagctggatgggccctggaacagatagggtcggaacttcctcaataccgtgctgtcgaaaacgtgttgcatacttcgctgactaatatcgaagctgtattgcacccgctgccaacactgttaaacgctgctcgttgtgagtctggtaccccattccaatattataccgaggggattacgccatcagtcgggagtcttgcggagaaagtggacgctgaacgcatagcaatcgcaaaggctttcgatttaaacgttccgtcggtctgcgaatggcataagagcagttacggccagtcaccggccacaatttatgaagcggtgcagggtaatcctgctctgcgcggcattatgggacctaccaaccttaacacggtgcacttcttcgaggatgtaagcaccggactggtaccgttatccgaactgggtcgggcagtgaatgtgcctaccccacttatcgatgctgttcttgacttgatcagttcgctgatagacacggatttcagaaaggaaggtcgtaccttggaaaaattaggtctgagcggacttaccgccgcgggcataagaagtgctgttgag

SEQ ID NO: 398 - protein, 359 aa, Artificial Sequence
  Engineered variant of opine dehydrogenase CENDH
MIESKTYAVLGLGNGGHAFAAYLALKGQRVLAWDIDAQRIKEIQDRGAIIAEGPGLAGTAHPDLLTSDIGLAVKDADVILIVVPAIHHASIAANIASYISEGQLIILNPGATGGALEFRKILRENGAPEVTIGETSSMLFTCRSERPGQVTVNAITGAMDFACLPAAKAGWALEQIGSELPQYRAVENVLHTSLTNIEAVLHPLPTLLNAARCESGTPFQYYTEGITPSVGSLAEKVDAERIAIAKAFDLNVPSVCEWHKSSYGQSPATIYEAVQGNPALRGIMGPTNLNTVHFFEDVSTGLVPLSELGRAVNVPTPLIDAVLDLISSLIDTDFRKEGRTLEKLGLSGLTAAGIRSAVE

SEQ ID NO: 399 - DNA, 1077 bp, Artificial Sequence
  Engineered variant of opine dehydrogenase CENDH
atgatcgagtcaaaaacatacgccgttttgggattaggaaacgggggtcacgcatttgccgcctatttagcattgaagggccagcgtgtactggcttgggacatcgatgctcagagaatcaaagagattcaggaccgtggagccatcatagcggaaggaccaggacttgctgggactgctcacccggatcttctgacctcagatataggtttggcggttaaagacgctgatgtgatactgattgtagtgccggccatccaccacgcttccattgcagcaaatatcgccagttacatttccgagggtcagttgattatccttaaccctggggcaacgggtggagcgctggaattccggaaaatcctgcgtgaaaatggtgcgccggaggtaacgatcggggaaacctcaagtatgctctttacatgccgctccgagagaccaggacaggttacggtaaatgcgataacaggcgccatggactttgcatgtctcccagcggcaaaagctggatgggccctggaacagatagggtcggttcttcctcaataccgtgctgtcgaaaacgtgttgcatacttcgctgactaatatcgaagctgtattgcacccgctgccaacactgttaaacgctgctcgttgtgagtctggtaccccattccaatattataccgaggggattacgccatcagtcgggagtcttgcggagaaagtggacgctgaacgcatagcaatcgcaaaggctttcgatttaaacgttccgtcggtctgcgaatggcataagagcagttacggcggttcaccggccacaatttatgaagcggtgcagggtaatcctgctctgcgcggcattatgggacctaccaaccttaacacggtgcacttcttcgaggatgtaagcaccggactggtaccgttatccgaactgggtcgggcagtgaatgtgcctaccccacttatcgatgctgttcttgacttgatcagttcgctgatagacacggatttcagaaaggaaggtcgtaccttggaaaaattaggtctgagcggacttaccgccgcgggcataagaagtgctgttgag

SEQ ID NO: 400 - protein, 359 aa, Artificial Sequence
  Engineered variant of opine dehydrogenase CENDH
MIESKTYAVLGLGNGGHAFAAYLALKGQRVLAWDIDAQRIKEIQDRGAIIAEGPGLAGTAHPDLLTSDIGLAVKDADVILIVVPAIHHASIAANIASYISEGQLIILNPGATGGALEFRKILRENGAPEVTIGETSSMLFTCRSERPGQVTVNAITGAMDFACLPAAKAGWALEQIGSVLPQYRAVENVLHTSLTNIEAVLHPLPTLLNAARCESGTPFQYYTEGITPSVGSLAEKVDAERIAIAKAFDLNVPSVCEWHKSSYGGSPATIYEAVQGNPALRGIMGPTNLNTVHFFEDVSTGLVPLSELGRAVNVPTPLIDAVLDLISSLIDTDFRKEGRTLEKLGLSGLTAAGIRSAVE

SEQ ID NO: 401 - DNA, 1077 bp, Artificial Sequence
  Engineered variant of opine dehydrogenase CENDH
atgatcgagtcaaaaacatacgccgttttgggattaggaaacgggggtcacgcatttgccgcctatttagcattgaagggccagcgtgtactggcttgggacatcgatgctcagagaatcaaagagattcaggaccgtggagccatcatagcggaaggaccaggacttgctgggactgctcacccggatcttctgacctcagatataggtttggcggttaaagacgctgatgtgatactgattgtagtgccggccatccaccacgcttccattgcagcaaatatcgccagttacatttccgagggtcagttgattatccttaaccctggggcaacgggtggagcgctggaattccggaaaatcctgcgtgaaaatggtgcgccggaggtaacgatcggggaaacctcaagtatgctctttacatgccgctccgagagaccaggacaggttacggtaaatgcgataacaggcgccatggactttgcatgtctcccagcggcaaaagctggatgggccctggaacagatatgttcggttcttcctcaataccgtgctgtcgaaaacgtgttgcatacttcgctgactaatatcgaagctgtattgcacccgctgccaacactgttaaacgctgctcgttgtgagtctggtaccccattccaatattataccgaggggattacgccatcagtcgggagtcttgcggagaaagtggacgctgaacgcatagcaatcgcaaaggctttcgatttaaacgttccgtcggtctgcgaatggcataagagcagttacggccagtcaccggccacaatttatgaagcggtgcagggtaatcctgctctgcgcggcattatgggacctaccaaccttaacacggtgcacttcttcgaggatgtaagcaccggactggtaccgttatccgaactgggtcgggcagtgaatgtgcctaccccacttatcgatgctgttcttgacttgatcagttcgctgatagacacggatttcagaaaggaaggtcgtaccttggaaaaattaggtctgagcggacttaccgccgcgggcataagaagtgctgttgag

SEQ ID NO: 402 - protein, 359 aa, Artificial Sequence
  Engineered variant of opine dehydrogenase CENDH
MIESKTYAVLGLGNGGHAFAAYLALKGQRVLAWDIDAQRIKEIQDRGAIIAEGPGLAGTAHPDLLTSDIGLAVKDADVILIVVPAIHHASIAANIASYISEGQLIILNPGATGGALEFRKILRENGAPEVTIGETSSMLFTCRSERPGQVTVNAITGAMDFACLPAAKAGWALEQICSVLPQYRAVENVLHTSLTNIEAVLHPLPTLLNAARCESGTPFQYYTEGITPSVGSLAEKVDAERIAIAKAFDLNVPSVCEWHKSSYGQSPATIYEAVQGNPALRGIMGPTNLNTVHFFEDVSTGLVPLSELGRAVNVPTPLIDAVLDLISSLIDTDFRKEGRTLEKLGLSGLTAAGIRSAVE

SEQ ID NO: 403 - DNA, 1077 bp, Artificial Sequence
  Engineered variant of opine dehydrogenase CENDH
atgatcgagtcaaaaacatacgccgttttgggattaggaaacgggggtcacgcatttgccgcctatttagcattgaagggccagcgtgtactggcttgggacatcgatgctcagagaatcaaagagattcaggaccgtggagccatcatagcggaaggaccaggacttgctgggactgctcacccggatcttctgacctcagatataggtttggcggttaaagacgctgatgtgatactgattgtagtgccggccatccaccacgcttccattgcagcaaatatcgccagttacatttccgagggtcagttgattatccttaaccctggggcaacgggtggagcgctggaattccggaaaatcctgcgtgaaaatggtgcgccggaggtaacgatcggggaaacctcaagtatgctctttacatgccgctccgagagaccaggacaggttacggtaaatgcgataacaggcgccatggactttgcatgtctcccagcggcaaaagctggatgggccctggaacagatagggtcggttcttcctcaataccgtgctgtcgaaaacgtgttgcatacttcgctgactaatatcgaagctgtattgcacccgctgccaacactgttaaacgctgctcgttgtgagtctggtaccccattccaatattataccgaggggattacgccatcagtcgggagtcttgcggagaaagtggacgctgaacgcatagcaatcgcaaaggctttcgatttaaacgttccgtcggtcgttgaatggcataagagcagttacggccagtcaccggccacaatttatgaagcggtgcagggtaatcctgctctgcgcggcattatgggacctaccaaccttaacacggtgcacttcttcgaggatgtaagcaccggactggtaccgttatccgaactgggtcgggcagtgaatgtgcctaccccacttatcgatgctgttcttgacttgatcagttcgctgatagacacggatttcagaaaggaaggtcgtaccttggaaaaattaggtctgagcggacttaccgccgcgggcataagaagtgctgttgag

SEQ ID NO: 404 - protein, 359 aa, Artificial Sequence
  Engineered variant of opine dehydrogenase CENDH
MIESKTYAVLGLGNGGHAFAAYLALKGQRVLAWDIDAQRIKEIQDRGAIIAEGPGLAGTAHPDLLTSDIGLAVKDADVILIVVPAIHHASIAANIASYISEGQLIILNPGATGGALEFRKILRENGAPEVTIGETSSMLFTCRSERPGQVTVNAITGAMDFACLPAAKAGWALEQIGSVLPQYRAVENVLHTSLTNIEAVLHPLPTLLNAARCESGTPFQYYTEGITPSVGSLAEKVDAERIAIAKAFDLNVPSVVEWHKSSYGQSPATIYEAVQGNPALRGIMGPTNLNTVHFFEDVSTGLVPLSELGRAVNVPTPLIDAVLDLISSLIDTDFRKEGRTLEKLGLSGLTAAGIRSAVE

SEQ ID NO: 405 - DNA, 1077 bp, Artificial Sequence
  Engineered variant of opine dehydrogenase CENDH
atgatcgagtcaaaaacatacgccgttttgggattaggaaacgggggtcacgcatttgccgcctatttagcattgaagggccagcgtgtactggcttgggacatcgatgctcagagaatcaaagagattcaggaccgtggagccatcatagcggaaggaccaggacttgctgggactgctcacccggatcttctgacctcagatataggtttggcggttaaagacgctgatgtgatactgattgtagtgccggccatccaccacgcttccattgcagcaaatatcgccagttacatttccgagggtcagttgattatccttaaccctggggcaacgggtggagcgctggaattccggaaaatcctgcgtgaaaatggtgcgccggaggtaacgatcggggaaacctcaagtatgctctttacatgccgctccgagagaccaggacaggttacggtaaatgcgataacaggcgccatggactttgcatgtctcccagcggcaaaagctggatgggccctggaacagatagggtcggttcttcctcaataccgtgctgtcgaaaacgtgttgcatacttcgctgactaatatcgaagctgtattgcacccgctgccaacactgttaaacgctgctcgttgtgagtctggtaccccattccaatattataccgaggggattacgccatcagtcgggagtcttgcggagaaagtggacgctgaacgcatagcaatcgcaaaggctttcgatttaaacgttccgtcggtctgcgaatggcataagagcagttacggccagtcaccggccacaatttatgaagcggtgcagggtaatcctgctctgcgcggcattatgggacctaccaaccttaacacggtgcacgcattcgaggatgtaagcaccggactggtaccgttatccgaactgggtcgggcagtgaatgtgcctaccccacttatcgatgctgttcttgacttgatcagttcgctgatagacacggatttcagaaaggaaggtcgtaccttggaaaaattaggtctgagcggacttaccgccgcgggcataagaagtgctgttgag

SEQ ID NO: 406 - protein, 359 aa, Artificial Sequence
  Engineered variant of opine dehydrogenase CENDH
MIESKTYAVLGLGNGGHAFAAYLALKGQRVLAWDIDAQRIKEIQDRGAIIAEGPGLAGTAHPDLLTSDIGLAVKDADVILIVVPAIHHASIAANIASYISEGQLIILNPGATGGALEFRKILRENGAPEVTIGETSSMLFTCRSERPGQVTVNAITGAMDFACLPAAKAGWALEQIGSVLPQYRAVENVLHTSLTNIEAVLHPLPTLLNAARCESGTPFQYYTEGITPSVGSLAEKVDAERIAIAKAFDLNVPSVCEWHKSSYGQSPATIYEAVQGNPALRGIMGPTNLNTVHAFEDVSTGLVPLSELGRAVNVPTPLIDAVLDLISSLIDTDFRKEGRTLEKLGLSGLTAAGIRSAVE

SEQ ID NO: 407 - DNA, 1077 bp, Artificial Sequence
  Engineered variant of opine dehydrogenase CENDH
atgatcgagtcaaaaacatacgccgttttgggattaggaaacgggggtcacgcatttgccgcctatttagcattgaagggccagcgtgtactggcttgggacatcgatgctcagagaatcaaagagattcaggaccgtggagccatcatagcggaaggaccaggacttgctgggactgctcacccggatcttctgacctcagatataggtttggcggttaaagacgctgatgtgatactgattgtagtgccggccatccaccacgcttccattgcagcaaatatcgccagttacatttccgagggtcagttgattatccttaaccctggggcaacgggtggagcgctggaattccggaaaatcctgcgtgaaaatggtgcgccggaggtaacgatcggggaaacctcaagtatgctctttacatgccgctccgagagaccaggacaggttacggtaaatgcgataacaggcgccatggactttgcatgtctcccagcggcaaaagctggatgggccctggaacagatagggtcggttcttcctcaataccgtgctgtcgaaaacgtgttgcatacttcgctgactaatatcgaagctgtattgcacccgctgccaacactgttaaacgctgctcgttgtgagtctggtaccccattccaatattataccgaggggattacgccatcagtcgggagtcttgcggagaaagtggacgctgaacgcatagcaatcgcaaaggctttcgatttaaacgttccgtcggtctgcgaatggcataagagcagttacggccagtcaccggccacaatttatgaagcggtgcagggtaatcctgctctgcgcggcattatgggacctaccaaccttaacacggtgcacgttttcgaggatgtaagcaccggactggtaccgttatccgaactgggtcgggcagtgaatgtgcctaccccacttatcgatgctgttcttgacttgatcagttcgctgatagacacggatttcagaaaggaaggtcgtaccttggaaaaattaggtctgagcggacttaccgccgcgggcataagaagtgctgttgag

SEQ ID NO: 408 - protein, 359 aa, Artificial Sequence
  Engineered variant of opine dehydrogenase CENDH
MIESKTYAVLGLGNGGHAFAAYLALKGQRVLAWDIDAQRIKEIQDRGAIIAEGPGLAGTAHPDLLTSDIGLAVKDADVILIVVPAIHHASIAANIASYISEGQLIILNPGATGGALEFRKILRENGAPEVTIGETSSMLFTCRSERPGQVTVNAITGAMDFACLPAAKAGWALEQIGSVLPQYRAVENVLHTSLTNIEAVLHPLPTLLNAARCESGTPFQYYTEGITPSVGSLAEKVDAERIAIAKAFDLNVPSVCEWHKSSYGQSPATIYEAVQGNPALRGIMGPTNLNTVHVFEDVSTGLVPLSELGRAVNVPTPLIDAVLDLISSLIDTDFRKEGRTLEKLGLSGLTAAGIRSAVE

SEQ ID NO: 409 - DNA, 1077 bp, Artificial Sequence; identical to SEQ ID NO: 407
  Engineered variant of opine dehydrogenase CENDH

SEQ ID NO: 410 - protein, 359 aa, Artificial Sequence; identical to SEQ ID NO: 408
  Engineered variant of opine dehydrogenase CENDH

SEQ ID NO: 411 - DNA, 1077 bp, Artificial Sequence; identical to SEQ ID NO: 405
  Engineered variant of opine dehydrogenase CENDH

SEQ ID NO: 412 - protein, 359 aa, Artificial Sequence; identical to SEQ ID NO: 406
  Engineered variant of opine dehydrogenase CENDH

SEQ ID NO: 413 - DNA, 1077 bp, Artificial Sequence
  Engineered variant of opine dehydrogenase CENDH
atgatcgagtcaaaaacatacgccgttttgggattaggaaacgggggtcacgcatttgccgcctatttagcattgaagggccagcgtgtactggcttgggacatcgatgctcagagaatcaaagagattcaggaccgtggagccatcatagcggaaggaccaggacttgctgggactgctcacccggatcttctgacctcagatataggtttggcggttaaagacagtgatgtgatactgattgtagtgccggccatccaccacgcttccattgcagcaaatatcgccagttacatttccgagggtcagttgattatccttaaccctggggcaacgggtggagcgctggaattccggaaaatcctgcgtgaaaatggtgcgccggaggtaacgatcggggaaacctcaagtatgctctttacatgccgctccgagagaccaggacaggttacggtaaatgcgataacaggcgccatggactttgcatgtctcccagcggcaaaagctggatgggccctggaacagatagggtcggttcttcctcaataccgtgctgtcgaaaacgtgttgcatacttcgctgactaatatcgaagctgtattgcacccgctgccaacactgttaaacgctgctcgttgtgagtctggtaccccattccaatattataccgaggggattacgccatcagtcgggagtcttgcggagaaagtggacgctgaacgcatagcaatcgcaaaggctttcgatttaaacgttccgtcggtctgcgaatggcataagagcagttacggccagtcaccggccacaatttatgaagcggtgcagggtaatcctgctctgcgcggcattatgggacctaccaaccttaacacggtgcacttcttcgaggatgtaagcaccggactggtaccgttatccgaactgggtcgggcagtgaatgtgcctaccccacttatcgatgctgttcttgacttgatcagttcgctgatagacacggatttcagaaaggaaggtcgtaccttggaaaaattaggtctgagcggacttaccgccgcgggcataagaagtgctgttgag

SEQ ID NO: 414 - protein, 359 aa, Artificial Sequence
  Engineered variant of opine dehydrogenase CENDH
MIESKTYAVLGLGNGGHAFAAYLALKGQRVLAWDIDAQRIKEIQDRGAIIAEGPGLAGTAHPDLLTSDIGLAVKDSDVILIVVPAIHHASIAANIASYISEGQLIILNPGATGGALEFRKILRENGAPEVTIGETSSMLFTCRSERPGQVTVNAITGAMDFACLPAAKAGWALEQIGSVLPQYRAVENVLHTSLTNIEAVLHPLPTLLNAARCESGTPFQYYTEGITPSVGSLAEKVDAERIAIAKAFDLNVPSVCEWHKSSYGQSPATIYEAVQGNPALRGIMGPTNLNTVHFFEDVSTGLVPLSELGRAVNVPTPLIDAVLDLISSLIDTDFRKEGRTLEKLGLSGLTAAGIRSAVE

SEQ ID NO: 415 - DNA, 1077 bp, Artificial Sequence
  Engineered variant of opine dehydrogenase CENDH
atgatcgagtcaaaaacatacgccgttttgggattaggaaacgggggtcacgcatttgccgcctatttagcattgaagggccagcgtgtactggcttgggacatcgatgctcagagaatcaaagagattcaggaccgtggagccatcatagcggaaggaccaggacttgctgggactgctcacccggatcttctgacctcagatataggtttggcggttaaagacgctgatgtgatactgattgtagtgccggccatccaccacgcttccattgcagcaaatatcgccagttacatttccgagggtcagttgattatccttaaccctggggcaacgggtggagcgctggaattccggaaaatcctgcgtgaaaatggtgcgccggaggtaacgatcggggaaacctcaagtatgctctttacatgccgctccgagagaccaggacaggttacggtaaatgcgataacaggcgccatggactttgcaacactcccagcggcaaaagctggatgggccctggaacagatagggtcggttcttcctcaataccgtgctgtcgaaaacgtgttgcatacttcgctgactaatatcgaagctgtattgcacccgctgccaacactgttaaacgctgctcgttgtgagtctggtaccccattccaatattataccgaggggattacgccatcagtcgggagtcttgcggagaaagtggacgctgaacgcatagcaatcgcaaaggctttcgatttaaacgttccgtcggtctgcgaatggcataagagcagttacggccagtcaccggccacaatttatgaagcggtgcagggtaatcctgctctgcgcggcattatgggacctaccaaccttaacacggtgcacttcttcgaggatgtaagcaccggactggtaccgttatccgaactgggtcgggcagtgaatgtgcctaccccacttatcgatgctgttcttgacttgatcagttcgctgatagacacggatttcagaaaggaaggtcgtaccttggaaaaattaggtctgagcggacttaccgccgcgggcataagaagtgctgttgag

SEQ ID NO: 416 - protein, 359 aa, Artificial Sequence
  Engineered variant of opine dehydrogenase CENDH
MIESKTYAVLGLGNGGHAFAAYLALKGQRVLAWDIDAQRIKEIQDRGAIIAEGPGLAGTAHPDLLTSDIGLAVKDADVILIVVPAIHHASIAANIASYISEGQLIILNPGATGGALEFRKILRENGAPEVTIGETSSMLFTCRSERPGQVTVNAITGAMDFATLPAAKAGWALEQIGSVLPQYRAVENVLHTSLTNIEAVLHPLPTLLNAARCESGTPFQYYTEGITPSVGSLAEKVDAERIAIAKAFDLNVPSVCEWHKSSYGQSPATIYEAVQGNPALRGIMGPTNLNTVHFFEDVSTGLVPLSELGRAVNVPTPLIDAVLDLISSLIDTDFRKEGRTLEKLGLSGLTAAGIRSAVE

SEQ ID NO: 417 - DNA, 1077 bp, Artificial Sequence; identical to SEQ ID NO: 393
  Engineered variant of opine dehydrogenase CENDH

SEQ ID NO: 418 - protein, 359 aa, Artificial Sequence; identical to SEQ ID NO: 394
  Engineered variant of opine dehydrogenase CENDH

SEQ ID NO: 419 - DNA, 1077 bp, Artificial Sequence
  Engineered variant of opine dehydrogenase CENDH
atgatcgagtcaaaaacatacgccgttttgggattaggaaacgggggtcacgcatttgccgcctatttagcattgaagggccagcgtgtactggcttgggacatcgatgctcagagaatcaaagagattcaggaccgtggagccatcatagcggaaggaccaggacttgctgggactgctcacccggatcttctgacctcagatataggtttggcggttaaagacgctgatgtgatactgattgtagtgccggccatccaccacgcttccattgcagcaaatatcgccagttacatttccgagggtcagttgattatccttaaccctggggcaacgggtggagcgctggaattccggaaaatcctgcgtgaaaatggtgcgccggaggtaacgatcggggaaacctcaagtatgctctttacatgccgctccgagagaccaggacaggttacggtaaatgcgataacaggcgccatggactttgcatgtctcccagcggcaaaagctggatgggccctggaacagatagggtcggttcttcctcaataccgtgctgtcgaaaacgtgttgcatacttcgctgactaatatcgaagctgtattgcacccgctgccaacactgttaaacgctgctcgttgtgagtctggtaccccattccaatattataccgaggggattacgccatcagtcgggagtcttgcggagaaagtggacgctgaacgcatagcaatcgcaaaggctttcgatttaaacgttccgtcggtctgcgaatggcataagagcagttacggccagtcaccggccacaatttatgaagcggtgcagggtaatcctgctctgcgcggcattatgggacctaccaaccttaacacggtgcacttcttcgaggatgtaagcaccggactggtaccgttatccgaactgggtcgggcagtgaatgtgcctaccccacttatcgatgctgttgttgacttgatcagttcgctgatagacacggatttcagaaaggaaggtcgtaccttggaaaaattaggtctgagcggacttaccgccgcgggcataagaagtgctgttgag

SEQ ID NO: 420 - protein, 359 aa, Artificial Sequence
  Engineered variant of opine dehydrogenase CENDH
MIESKTYAVLGLGNGGHAFAAYLALKGQRVLAWDIDAQRIKEIQDRGAIIAEGPGLAGTAHPDLLTSDIGLAVKDADVILIVVPAIHHASIAANIASYISEGQLIILNPGATGGALEFRKILRENGAPEVTIGETSSMLFTCRSERPGQVTVNAITGAMDFACLPAAKAGWALEQIGSVLPQYRAVENVLHTSLTNIEAVLHPLPTLLNAARCESGTPFQYYTEGITPSVGSLAEKVDAERIAIAKAFDLNVPSVCEWHKSSYGQSPATIYEAVQGNPALRGIMGPTNLNTVHFFEDVSTGLVPLSELGRAVNVPTPLIDAVVDLISSLIDTDFRKEGRTLEKLGLSGLTAAGIRSAVE

SEQ ID NO: 421 - DNA, 1077 bp, Artificial Sequence
  Engineered variant of opine dehydrogenase CENDH
atgatcgagtcaaaaacatacgccgttttgggattaggaaacgggggtcacgcatttgccgcctatttagcattgaagggccagcgtgtactggcttgggacatcgatgctcagagaatcaaagagattcaggaccgtggagccatcatagcggaaggaccaggacttgctgggactgctcacccggatcttctgacctcagatataggtttggcggttaaagacgctgatgtgatactgattgtagtgccggccatccaccacgcttccattgcagcaaatatcgccagttacatttccgagggtcagttgattatccttaaccctggggcaacgggtggagcgctggaattccggaaaatcctgcgtgaaaatggtgcgccggaggtaacgatcggggaaacctcaagtatgctctttacatgccgctccgagagaccaggacaggttacggtaaatgcgataacaggcgccatggactttgcatgtctcccagcggcaaaagctggatgggccctggaacagatagggtcggttcttcctcaataccgtgctgtcgaaaacgtgttgcatacttcgctgactaatatcgaagctgtattgcacccgctgccaacactgttaaacgctgctcgttgtgagtctggtaccccattccaatattataccgaggggattacgccatcagtcgggagtcttgcggagaaagtggacgctgaacgcatagcaatcgcaaaggctttcgatttaaacgttccgtcggtctgcgaatggcataagagcagttacggccagtcaccggccacaatttatgaagcggtgcagggtaatcctgctctgcgcggcattatgggacctaccaaccttaacacggtgcacttcttcgaggatgtaagcaccggactggtaccgttatccgaactgggtcgggcagtgaatgtgcctaccccacttatcgatgctgttattgacttgatcagttcgctgatagacacggatttcagaaaggaaggtcgtaccttggaaaaattaggtctgagcggacttaccgccgcgggcataagaagtgctgttgag

SEQ ID NO: 422 - protein, 359 aa, Artificial Sequence
  Engineered variant of opine dehydrogenase CENDH
MIESKTYAVLGLGNGGHAFAAYLALKGQRVLAWDIDAQRIKEIQDRGAIIAEGPGLAGTAHPDLLTSDIGLAVKDADVILIVVPAIHHASIAANIASYISEGQLIILNPGATGGALEFRKILRENGAPEVTIGETSSMLFTCRSERPGQVTVNAITGAMDFACLPAAKAGWALEQIGSVLPQYRAVENVLHTSLTNIEAVLHPLPTLLNAARCESGTPFQYYTEGITPSVGSLAEKVDAERIAIAKAFDLNVPSVCEWHKSSYGQSPATIYEAVQGNPALRGIMGPTNLNTVHFFEDVSTGLVPLSELGRAVNVPTPLIDAVIDLISSLIDTDFRKEGRTLEKLGLSGLTAAGIRSAVE

SEQ ID NO: 423 - DNA, 1077 bp, Artificial Sequence
  Engineered variant of opine dehydrogenase CENDH
atgatcgagtcaaaaacatacgccgttttgggattaggaaacgggggtcacgcatttgccgcctatttagcattgaagggccagcgtgtactggcttgggacatcgatgctcagagaatcaaagagattcaggaccgtggagccatcatagcggaaggaccaggacttgctgggactgctcacccggatcttctgacctcagatataggtttggcggttaaagacgctgatgtgatactgattgtagtgccggccatccaccacgcttccattgcagcaaatatcgccagttacatttccgagggtcagttgattatccttaaccctggggcaacgggtggagcgctggaattccggaaaatcctgcgtgaaaatggtgcgccggaggtaacgatcggggaaacctcaagtatgctctttacatgccgctccgagagaccaggacaggttacggtaaatgcgataacaggcgccatggactttgcatgtctcccagcggcaaaagctggatgggccctggaacagatagggtcggttcttcctcaataccgtgctgtcgaaaacgtgttgcatacttcgctgactaatatcgaagctgtattgcacccgctgccaacactgttaaacgctgctcgttgtgagtctggtaccccattccaatattataccgaggggattacgccatcagtcgggagtcttgcggagaaagtggacgctgaacgcatagcaatcgcaaaggctttcgatttaaacgttccgtcggtctgcgaatggcataagagcagttacggccagtcaccggccacaatttatgaagcggtgcagggtaatcctgctctgcgcggcattatgggacctaccaaccttaacacggtgcacttcttcgaggatgtaagcaccggactggtaccgttatccgaactgggtcgggcagtgaatgtgcctaccccacttatcgatgctgttacagacttgatcagttcgctgatagacacggatttcagaaaggaaggtcgtaccttggaaaaattaggtctgagcggacttaccgccgcgggcataagaagtgctgttgag

SEQ ID NO: 424 - protein, 359 aa, Artificial Sequence
  Engineered variant of opine dehydrogenase CENDH
MIESKTYAVLGLGNGGHAFAAYLALKGQRVLAWDIDAQRIKEIQDRGAIIAEGPGLAGTAHPDLLTSDIGLAVKDADVILIVVPAIHHASIAANIASYISEGQLIILNPGATGGALEFRKILRENGAPEVTIGETSSMLFTCRSERPGQVTVNAITGAMDFACLPAAKAGWALEQIGSVLPQYRAVENVLHTSLTNIEAVLHPLPTLLNAARCESGTPFQYYTEGITPSVGSLAEKVDAERIAIAKAFDLNVPSVCEWHKSSYGQSPATIYEAVQGNPALRGIMGPTNLNTVHFFEDVSTGLVPLSELGRAVNVPTPLIDAVTDLISSLIDTDFRKEGRTLEKLGLSGLTAAGIRSAVE

SEQ ID NO: 425 - DNA, 1077 bp, Artificial Sequence; identical to SEQ ID NO: 419
  Engineered variant of opine dehydrogenase CENDH

SEQ ID NO: 426 - protein, 359 aa, Artificial Sequence; identical to SEQ ID NO: 420
  Engineered variant of opine dehydrogenase CENDH

SEQ ID NO: 427 - DNA, 1077 bp, Artificial Sequence
  Engineered variant of opine dehydrogenase CENDH
atgatcgagtcaaaaacatacgccgttttgggattaggaaacgggggtcacgcatttgccgcctatttagcattgaagggccagcgtgtactggcttgggacatcgatgctcagagaatcaaagagattcaggaccgtggagccatcatagcggaaggaccaggacttgctgggactgctcacccggatcttctgacctcagatataggtttggcggttaaagacgctgatgtgatactgattgtagtgccggccatccaccacgcttccattgcagcaaatatcgccagttacatttccgagggtcagttgattatccttaaccctggggcaacgggtggagcgctggaattccggaaaatcctgcgtgaaaatggtgcgccggaggtaacgatcggggaaacctcaagtatgctctttacatgccgctccgagagaccaggacaggttacggtaaatgcgataacaatggccatggactttgcatgtctcccagcggcaaaagctggatgggccctggaacagatagggtcggttcttcctcaataccgtgctgtcgaaaacgtgttgcatacttcgctgactaatatcgaagctgtattgcacccgctgccaacactgttaaacgctgctcgttgtgagtctggtaccccattccaatattataccgaggggattacgccatcagtcgggagtcttgcggagaaagtggacgctgaacgcatagcaatcgcaaaggctttcgatttaaacgttccgtcggtctgcgaatggcataagagcagttacggccagtcaccggccacaatttatgaagcggtgcagggtaatcctgctctgcgcggcattatgggacctaccaaccttaacacggtgcacttcttcgaggatgtaagcaccggactggtaccgttatccgaactgggtcgggcagtgaatgtgcctaccccacttatcgatgctgttcttgacttgatcagttcgctgatagacacggatttcagaaaggaaggtcgtaccttggaaaaattaggtctgagcggacttaccgccgcgggcataagaagtgctgttgag

SEQ ID NO: 428 - protein, 359 aa, Artificial Sequence
  Engineered variant of opine dehydrogenase CENDH
MIESKTYAVLGLGNGGHAFAAYLALKGQRVLAWDIDAQRIKEIQDRGAIIAEGPGLAGTAHPDLLTSDIGLAVKDADVILIVVPAIHHASIAANIASYISEGQLIILNPGATGGALEFRKILRENGAPEVTIGETSSMLFTCRSERPGQVTVNAITMAMDFACLPAAKAGWALEQIGSVLPQYRAVENVLHTSLTNIEAVLHPLPTLLNAARCESGTPFQYYTEGITPSVGSLAEKVDAERIAIAKAFDLNVPSVCEWHKSSYGQSPATIYEAVQGNPALRGIMGPTNLNTVHFFEDVSTGLVPLSELGRAVNVPTPLIDAVLDLISSLIDTDFRKEGRTLEKLGLSGLTAAGIRSAVE

SEQ ID NO: 429 - DNA, 1077 bp, Artificial Sequence
  Engineered variant of opine dehydrogenase CENDH
atgatcgagtcaaaaacatacgccgttttgggattaggaaacgggggtcacgcatttgccgcctatttagcattgaagggccagcgtgtactggcttgggacatcgatgctcagagaatcaaagagattcaggaccgtggagccatcatagcggaaggaccaggacttgctgggactgctcacccggatcttctgacctcagatataggtttggcggttaaagacgctgatgtgatactgattgtagtgccggccatccaccacgcttccattgcagcaaatatcgccagttacatttccgagggtcagttgattatccttaaccctggggcaacgggtggagcgctggaattccggaaaatcctgcgtgaaaatggtgcgccggaggtaacgatcggggaaacctcaagtatgctctttacatgccgctccgagagaccaggacaggttacggtaaattatataacaggcgccatggactttgcatgtctcccagcggcaaaagctggatgggccctggaacagatagggtcggttcttcctcaataccgtgctgtcgaaaacgtgttgcatacttcgctgactaatatcgaagctgtattgcacccgctgccaacactgttaaacgctgctcgttgtgagtctggtaccccattccaatattataccgaggggattacgccatcagtcgggagtcttgcggagaaagtggacgctgaacgcatagcaatcgcaaaggctttcgatttaaacgttccgtcggtctgcgaatggcataagagcagttacggccagtcaccggccacaatttatgaagcggtgcagggtaatcctgctctgcgcggcattatgggacctaccaaccttaacacggtgcacttcttcgaggatgtaagcaccggactggtaccgttatccgaactgggtcgggcagtgaatgtgcctaccccacttatcgatgctgttcttgacttgatcagttcgctgatagacacggatttcagaaaggaaggtcgtaccttggaaaaattaggtctgagcggacttaccgccgcgggcataagaagtgctgttgag

SEQ ID NO: 430 - protein, 359 aa, Artificial Sequence
  Engineered variant of opine dehydrogenase CENDH
MIESKTYAVLGLGNGGHAFAAYLALKGQRVLAWDIDAQRIKEIQDRGAIIAEGPGLAGTAHPDLLTSDIGLAVKDADVILIVVPAIHHASIAANIASYISEGQLIILNPGATGGALEFRKILRENGAPEVTIGETSSMLFTCRSERPGQVTVNYITGAMDFACLPAAKAGWALEQIGSVLPQYRAVENVLHTSLTNIEAVLHPLPTLLNAARCESGTPFQYYTEGITPSVGSLAEKVDAERIAIAKAFDLNVPSVCEWHKSSYGQSPATIYEAVQGNPALRGIMGPTNLNTVHFFEDVSTGLVPLSELGRAVNVPTPLIDAVLDLISSLIDTDFRKEGRTLEKLGLSGLTAAGIRSAVE

SEQ ID NO: 431 - DNA, 1077 bp, Artificial Sequence
  Engineered variant of opine dehydrogenase CENDH
atgatcgagtcaaaaacatacgccgttttgggattaggaaacgggggtcacgcatttgccgcctatttagcattgaagggccagcgtgtactggcttgggacatcgatgctcagagaatcaaagagattcaggaccgtggagccatcatagcggaaggaccaggacttgctgggactgctcacccggatcttctgacctcagatataggtttggcggttaaagacgctgatgtgatactgattgtagtgccggccatccaccacgcttccattgcagcaaatatcgccagttacatttccgagggtcagttgattatccttaaccctggggcaacgggtggagcgctggaattccggaaaatcctgcgtgaaaatggtgcgccggaggtaacgatcggggaaacctcaagtatgctctttacatgccgctccgagagaccaggacaggttacggtaaatgcgataacaggcgccatggactttgcatgtctcccagcggcaaaagctggatgggccctggaacagatagggtcggttcttcctcaataccgtgctgtcgaaaacgtgttgcatacttcgctgactaatatcgaagctgtattgcacccgctgccaacactgttaaacgctgctcgttgtgagtctggtaccccattccaatattataccgaggggattacgccatcagtcgggagtcttgcggagaaagtggacgctgaacgcatagcaatcgcattggctttcgatttaaacgttccgtcggtctgcgaatggcataagagcagttacggccagtcaccggccacaatttatgaagcggtgcagggtaatcctgctctgcgcggcattatgggacctaccaaccttaacacggtgcacttcttcgaggatgtaagcaccggactggtaccgttatccgaactgggtcgggcagtgaatgtgcctaccccacttatcgatgctgttcttgacttgatcagttcgctgatagacacggatttcagaaaggaaggtcgtaccttggaaaaattaggtctgagcggacttaccgccgcgggcataagaagtgctgttgag

SEQ ID NO: 432 - protein, 359 aa, Artificial Sequence
  Engineered variant of opine dehydrogenase CENDH
MIESKTYAVLGLGNGGHAFAAYLALKGQRVLAWDIDAQRIKEIQDRGAIIAEGPGLAGTAHPDLLTSDIGLAVKDADVILIVVPAIHHASIAANIASYISEGQLIILNPGATGGALEFRKILRENGAPEVTIGETSSMLFTCRSERPGQVTVNAITGAMDFACLPAAKAGWALEQIGSVLPQYRAVENVLHTSLTNIEAVLHPLPTLLNAARCESGTPFQYYTEGITPSVGSLAEKVDAERIAIALAFDLNVPSVCEWHKSSYGQSPATIYEAVQGNPALRGIMGPTNLNTVHFFEDVSTGLVPLSELGRAVNVPTPLIDAVLDLISSLIDTDFRKEGRTLEKLGLSGLTAAGIRSAVE

SEQ ID NO: 433 - DNA, 1077 bp, Artificial Sequence
  Engineered variant of opine dehydrogenase CENDH
atgatcgagcttaaaacatacgccgttttgggattaggaaacgggggtcacgcatttgccgcctatttagcattgaagggccagcgtgtactggcttgggacatcgatgctcagagaatcaaagagattcaggaccgtggagccatcatagcggaaggaccaggacttgctgggactgctcacccggatcttctgacctcagatataggtttggcggttaaagacgctgatgtgatactgattgtagtgccggccatccaccacgcttccattgcagcaaatatcgccagttacatttccgagggtcagttgattatccttaaccctggggcaacgggtggagcgctggaattccggaaaatcctgcgtgaaaatggtgcgccggaggtaacgatcggggaaacctcaagtatgctctttacatgccgctccgagagaccaggacaggttacggtaaatgcgataacaggcgccatggactttgcatgtctcccagcggcaaaagctggatgggccctggaacagatagggtcggttcttcctcaataccgtgctgtcgaaaacgtgttgcatacttcgctgactaatatcgaagctgtattgcacccgctgccaacactgttaaacgctgctcgttgtgagtctggtaccccattccaatattataccgaggggattacgccatcagtcgggagtcttgcggagaaagtggacgctgaacgcatagcaatcgcaaaggctttcgatttaaacgttccgtcggtctgcgaatggcataagagcagttacggccagtcaccggccacaatttatgaagcggtgcagggtaatcctgctctgcgcggcattatgggacctaccaaccttaacacggtgcacttcttcgaggatgtaagcaccggactggtaccgttatccgaactgggtcgggcagtgaatgtgcctaccccacttatcgatgctgttcttgacttgatcagttcgctgatagacacggatttcagaaaggaaggtcgtaccttggaaaaattaggtctgagcggacttaccgccgcgggcataagaagtgctgttgag

SEQ ID NO: 434 - protein, 359 aa, Artificial Sequence
  Engineered variant of opine dehydrogenase CENDH
MIELKTYAVLGLGNGGHAFAAYLALKGQRVLAWDIDAQRIKEIQDRGAIIAEGPGLAGTAHPDLLTSDIGLAVKDADVILIVVPAIHHASIAANIASYISEGQLIILNPGATGGALEFRKILRENGAPEVTIGETSSMLFTCRSERPGQVTVNAITGAMDFACLPAAKAGWALEQIGSVLPQYRAVENVLHTSLTNIEAVLHPLPTLLNAARCESGTPFQYYTEGITPSVGSLAEKVDAERIAIAKAFDLNVPSVCEWHKSSYGQSPATIYEAVQGNPALRGIMGPTNLNTVHFFEDVSTGLVPLSELGRAVNVPTPLIDAVLDLISSLIDTDFRKEGRTLEKLGLSGLTAAGIRSAVE

SEQ ID NO: 435 - DNA, 1077 bp, Artificial Sequence
  Engineered variant of opine dehydrogenase CENDH
atgatcgagtcaaaaacatacgccgttttgggattaggaaacgggggtcacgcatttgccgcctatttagcattgaagggccagcgtgtactggcttgggacatcgatgctcagagaatcaaagagattcaggaccgtggagccatcatagcggaaggaccaggacttgctgggactgctcacccggatcttctgacctcagatataaatttggcggttaaagacgctgatgtgatactgattgtagtgccggccatccaccacgcttccattgcagcaaatattgccagttacatttccgagggtcagttgattatccttaaccctggggcaacgggtggagcgctggaattccggaaaatcctgcgtgaaaatggtgcgccggaggtaacgatcggggaaacctcaagtatgctctttacatgccgctccgagagaccaggacaggttacggtaaatgcgataacaggcgccatggactttgcatgtctcccagcggcaaaagctggatgggccctggaacagatagggtcggttcttcctcaataccgtgctgtcgaaaacgtgttgcatacttcgctgactaatatcgaagctgtattgcacccgctgccaacactgttaaacgctgctcgttgtgagtctggtaccccattccaatattataccgaggggattacgccatcagtcgggagtcttgcggagaaagtggacgctgaacgcatagcaatcgcaaaggctttcgatttaaacgttccgtcggtctgcgaatggcataagagcagttacggccagtcaccggccacaatttatgaagcggtgcagggtaatcctgctctgcgcggcattatgggacctaccaaccttaacacggtgcacttcttcgaggatgtaagcaccggactggtaccgttatccgaactgggtcgggcagtgaatgtgcctaccccacttatcgatgctgttcttgacttgatcagttcgctgatagacacggatttcagaaaggaaggtcgtaccttggaaaaattaggtctgagcggacttaccgccgcgggcataagaagtgctgttgag

SEQ ID NO: 436 - protein, 359 aa, Artificial Sequence
  Engineered variant of opine dehydrogenase CENDH
MIESKTYAVLGLGNGGHAFAAYLALKGQRVLAWDIDAQRIKEIQDRGAIIAEGPGLAGTAHPDLLTSDINLAVKDADVILIVVPAIHHASIAANIASYISEGQLIILNPGATGGALEFRKILRENGAPEVTIGETSSMLFTCRSERPGQVTVNAITGAMDFACLPAAKAGWALEQIGSVLPQYRAVENVLHTSLTNIEAVLHPLPTLLNAARCESGTPFQYYTEGITPSVGSLAEKVDAERIAIAKAFDLNVPSVCEWHKSSYGQSPATIYEAVQGNPALRGIMGPTNLNTVHFFEDVSTGLVPLSELGRAVNVPTPLIDAVLDLISSLIDTDFRKEGRTLEKLGLSGLTAAGIRSAVE

SEQ ID NO: 437 - DNA, 1077 bp, Artificial Sequence
  Engineered variant of opine dehydrogenase CENDH
atgatcgagtcaaaaacatacgccgttttgggattaggaaacgggggtcacgcatttgccgcctatttagcattgaagggccagcgtgtactggcttgggacatcgatgctcagagaatcaaagagattcaggaccgtggagccatcatagcggaaggaccaggacttgctgggactgctcacccggatcttctgacctcagatataggtttggcggttaaagacgctgatgtgatactgattgtagtgccggccatccaccacgcttccattgcagcaaatatcgccagttacatttccgagggtcagttgattatccttaaccctggggcaacgggtggagcgctggaattccggaaaatcctgcgtgaaaatggtgcgccggaggtaacgatcggggaaacctcaagtatgctctttacatgccgctccgagagaccaggacaggttacggtaaatcaaataacaggcgccatggactttgcatgtctcccagcggcaaaagctggatgggccctggaacagatagggtcggttcttcctcaataccgtgctgtcgaaaacgtgttgcatacttcgctgactaatatcgaagctgtattgcacccgctgccaacactgttaaacgctgctcgttgtgagtctggtaccccattccaatattataccgaggggattacgccatcagtcgggagtcttgcggagaaagtggacgctgaacgcatagcaatcgcaaaggctttcgatttaaacgttccgtcggtctgcgaatggcataagagcagttacggccagtcaccggccacaatttatgaagcggtgcagggtaatcctgctctgcgcggcattatgggacctaccaaccttaacacggtgcacttcttcgaggatgtaagcaccggactggtaccgttatccgaactgggtcgggcagtgaatgtgcctaccccacttatcgatgctgttcttgacttgatcagttcgctgatagacacggatttcagaaaggaaggtcgtaccttggaaaaattaggtctgagcggacttaccgccgcgggcataagaagtgctgttgag

SEQ ID NO: 438 - protein, 359 aa, Artificial Sequence
  Engineered variant of opine dehydrogenase CENDH
MIESKTYAVLGLGNGGHAFAAYLALKGQRVLAWDIDAQRIKEIQDRGAIIAEGPGLAGTAHPDLLTSDIGLAVKDADVILIVVPAIHHASIAANIASYISEGQLIILNPGATGGALEFRKILRENGAPEVTIGETSSMLFTCRSERPGQVTVNQITGAMDFACLPAAKAGWALEQIGSVLPQYRAVENVLHTSLTNIEAVLHPLPTLLNAARCESGTPFQYYTEGITPSVGSLAEKVDAERIAIAKAFDLNVPSVCEWHKSSYGQSPATIYEAVQGNPALRGIMGPTNLNTVHFFEDVSTGLVPLSELGRAVNVPTPLIDAVLDLISSLIDTDFRKEGRTLEKLGLSGLTAAGIRSAVE

SEQ ID NO: 439 - DNA, 1077 bp, Artificial Sequence
  Engineered variant of opine dehydrogenase CENDH
atgatcgagtcaaaaacatacgccgttttgggattaggaaacgggggtcacgcatttgccgcctatttagcattgaagggccagcgtgtactggcttgggacatcgatgctcagagaatcaaagagattcaggaccgtggagccatcatagcggaaggaccaggacttgctgggactgctcacccggatcttctgacctcagatataggtttggcggttaaagacgctgatgtgatactgattgtagtgccggccatccaccacgcttccattgcagcaaatatcgccagttacatttccgagggtcagttgattatccttaaccctggggcaacgggtggagcgctggaattccggaaaatcctgcgtgaaaatggtgcgccggaggtaacgatcggggaaacctcaagtatgctctttacatgccgctccgagagaccaggacaggttacggtaaatgcgataacaggcgccatggactttgcatgtctcccagcggcaaaagctggatgggccctggaacagatagggtcggttcttcctcaataccgtgctgtcgaaaacgtgttgcatacttcgctgactaatatcgaagctgtattgcacccgctgccaacactgttaaacgctgctcgttgtgagtctggtaccccattccaatattataccgaggggattacgccatcagtcgggagtcttgcggagaaagtggacgctgaacgcatagcaatcgcaaaagctttcgatttaaacgttccgtcggtctgcgaatggcataagagcagttacggccagtcaccggccacaatttatgaagcggtgcagggtaatcctgctctgcgcggcattatgggacctaccaaccttaacacggtgcacttcttcgaggatgtaagcaccggactggtaccgttatccgaactgggtcgggcagtgaatgtgcctaccccacttatcgatgctgttcttgacttgatcagttcgctgatagacacggatttcagaaaggaaggtcgtaccttggaaaaattaggtctgagcggacttaccgccgcgggcataagaagtgctgttgag

SEQ ID NO: 440 - protein, 359 aa, Artificial Sequence; identical to SEQ ID NO: 252
  Engineered variant of opine dehydrogenase CENDH

SEQ ID NO: 441 - DNA, 1077 bp, Artificial Sequence
  Engineered variant of opine dehydrogenase CENDH
atgatcgagtcaaaaacatacgccgttttgggattaggaaacgggggtcacgcatttgccgcctatttagcattgaagggccagacagtactggcttgggacatcgatgctcagagaatcaaagagattcaggaccgtggagccatcatagcggaaggaccaggacttgctgggactgctcacccggatcttctgacctcagatataggtttggcggttaaagacgctgatgtgatactgattgtagtgccggccatccaccacgcttccattgcagcaaatatcgccagttacatttccgagggtcagttgattatccttaaccctggggcaacgggtggagcgctggaattccggaaaatcctgcgtgaaaatggtgcgccggaggtaacgatcggggaaacctcaagtatgctctttacatgccgctccgagagaccaggacaggttacggtaaatgcgataacaggcgccatggactttgcatgtctcccagcggcaaaagctggatgggccctggaacagatagggtcggttcttcctcaataccgtgctgtcgaaaacgtgttgcatacttcgctgactaatatcgaagctgtattgcacccgctgccaacactgttaaacgctgctcgttgtgagtctggtaccccattccaatattataccgaggggattacgccatcagtcgggagtcttgcggagaaagtggacgctgaacgcatagcaatcgcaaaggctttcgatttaaacgttccgtcggtctgcgaatggcataagagcagttacggccagtcaccggccacaatttatgaagcggtgcagggtaatcctgctctgcgcggcattatgggacctaccaaccttaacacggtgcacttcttcgaggatgtaagcaccggactggtaccgttatccgaactgggtcgggcagtgaatgtgcctaccccacttatcgatgctgttcttgacttgatcagttcgctgatagacacggatttcagaaaggaaggtcgtaccttggaaaaattaggtctgagcggacttaccgccgcgggcataagaagtgctgttgag

SEQ ID NO: 442 - protein, 359 aa, Artificial Sequence
  Engineered variant of opine dehydrogenase CENDH
MIESKTYAVLGLGNGGHAFAAYLALKGQTVLAWDIDAQRIKEIQDRGAIIAEGPGLAGTAHPDLLTSDIGLAVKDADVILIVVPAIHHASIAANIASYISEGQLIILNPGATGGALEFRKILRENGAPEVTIGETSSMLFTCRSERPGQVTVNAITGAMDFACLPAAKAGWALEQIGSVLPQYRAVENVLHTSLTNIEAVLHPLPTLLNAARCESGTPFQYYTEGITPSVGSLAEKVDAERIAIAKAFDLNVPSVCEWHKSSYGQSPATIYEAVQGNPALRGIMGPTNLNTVHFFEDVSTGLVPLSELGRAVNVPTPLIDAVLDLISSLIDTDFRKEGRTLEKLGLSGLTAAGIRSAVE

SEQ ID NO: 443 - DNA, 1077 bp, Artificial Sequence
  Engineered variant of opine dehydrogenase CENDH
atgatcgagtcaaaaacatacgccgttttgggattaggaaacgggggtcacgcatttgccgcctatttagcattgaagggccagcgtgtactggcttgggacatcgatgctcagagaatcaaagagattcaggaccgtggagccatcatagcggaaggaccaggacttgctgggactgctcacccggatcttctgacctcagatataggtttggcggttaaagacgctgatgtgatactgattgtagtgccggccatccaccacgcttccattgcagcaaatatcgccagttacatttccgagggtcagttgattatccttaaccctggggcaacgggtggagcgctggaattccggaaaatcctgcgtgaaaatggtgcgccggaggtaacgatcggggaaacctcaagtatgctctttacatgccgctccgagagaccaggacaggttacggtaaatgcgataacacgtgccatggactttgcatgtctcccagcggcaaaagctggatgggccctggaacagatagggtcggttcttcctcaataccaggctgtcgaaaacgtgttgcatacttcgctgactaatatcgaagctgtattgcacccgctgccaacactgttaaacgctgctcgttgtgagtctggtaccccattccattattataccgaggggattacgccatcagtcggggcgcttgcggagaaagtggacgctgaacgcatagcaatcgcaaaggctttcgatttaaacgttccgtcggtctgcgaatggcataagattagttacggccagtcaccggccacaatttatgaagcggtgcagggtaatcctgctctgcgcggcattatgggacctaccagccttaacacggtgcacttcttccttgatgtaagcaccggactggtaccgttatccgaactgggtcgggcagtgaatgtgcctaccccacttatcgatgctgttcttctgttgatcagttcgctgatagacgtggatttcagaaaggaaggtcgtaccttggaaaaattaggtctgagcggacttaccgccgcggaaataagaagtgctgttgag

SEQ ID NO: 444 - protein, 359 aa, Artificial Sequence
  Engineered variant of opine dehydrogenase CENDH
MIESKTYAVLGLGNGGHAFAAYLALKGQRVLAWDIDAQRIKEIQDRGAIIAEGPGLAGTAHPDLLTSDIGLAVKDADVILIVVPAIHHASIAANIASYISEGQLIILNPGATGGALEFRKILRENGAPEVTIGETSSMLFTCRSERPGQVTVNAITRAMDFACLPAAKAGWALEQIGSVLPQYQAVENVLHTSLTNIEAVLHPLPTLLNAARCESGTPFHYYTEGITPSVGALAEKVDAERIAIAKAFDLNVPSVCEWHKISYGQSPATIYEAVQGNPALRGIMGPTSLNTVHFFLDVSTGLVPLSELGRAVNVPTPLIDAVLLLISSLIDVDFRKEGRTLEKLGLSGLTAAEIRSAVE

SEQ ID NO: 445 - DNA, 1077 bp, Artificial Sequence
  Engineered variant of opine dehydrogenase CENDH
atgatcgagtcaaaaacatacgccgttttgggattaggaaacgggggtcacgcatttgccgcctatttagcattgaagggccagcgtgtactggcttgggacatcgatgctcagagaatcaaagagattcaggaccgtggagccatcatagcggaaggaccaggacttgctgggactgctcacccggatcttctgacctcagatataggtttggcggttaaagacgctgatgtgatactgattgtagtgccggccatccaccacgcttccattgcagcaaaaatcgccagttacatttccgagggtcagttgattatccttaaccctggggcaacgggtggagcgctggaattccggaaaatcctgcgtgaaaatggtgcgccggaggtaacgatcggggaaacctcaagtatgctctttacatgccgctccgagagaccaggacaggttacggtaaattatataacacgtgccatggactttgcatgtctcccagcggcaaaagctggatgggccctggaacagatagggtcggttcttcctcaatgccaggctgtcgaaaacgtgttgcatacttcgctgactaatatcgaagctgtattgcacccgctgccaacactgttaaacgctgctcgttgtgagtctggtaccccattccattattataccgaggggattacgccatcagtcggggcgcttgcggagaaagtggacgctgaacgcatagcaatcgcaaaggctttcgatttaaacgttccgtcggtctgcgaatggcataagattagttacggcctgtcaccggccacaatttatgaagcggtgcagggtaatcctgctctgcgcggcattatgggacctaccagccttaacacggtgcacttcttcgaggatgtaagcaccggactggtaccgttatccgaactgggtcgggcagtgaatgtgcctaccccacttatcgatgctgttcttctgttgatcagttcgctgatagacgtggatttcagaaaggaaggtcgtaccttggaaaaattaggtctgagcggacttaccgccgcggaaataagaagtgctgttgag

SEQ ID NO: 446 - protein, 359 aa, Artificial Sequence
  Engineered variant of opine dehydrogenase CENDH
MIESKTYAVLGLGNGGHAFAAYLALKGQRVLAWDIDAQRIKEIQDRGAIIAEGPGLAGTAHPDLLTSDIGLAVKDADVILIVVPAIHHASIAAKIASYISEGQLIILNPGATGGALEFRKILRENGAPEVTIGETSSMLFTCRSERPGQVTVNYITRAMDFACLPAAKAGWALEQIGSVLPQCQAVENVLHTSLTNIEAVLHPLPTLLNAARCESGTPFHYYTEGITPSVGALAEKVDAERIAIAKAFDLNVPSVCEWHKISYGLSPATIYEAVQGNPALRGIMGPTSLNTVHFFEDVSTGLVPLSELGRAVNVPTPLIDAVLLLISSLIDVDFRKEGRTLEKLGLSGLTAAEIRSAVE

SEQ ID NO: 447 - DNA, 1077 bp, Artificial Sequence
  Engineered variant of opine dehydrogenase CENDH
atgatcgagtcaaaaacatacgccgttttgggattaggaaacgggggtcacgcatttgccgcctatttagcattgaagggccagcgtgtactggcttgggacatcgatgctcagagaatcaaagagattcaggaccgtggagccatcatagcggaaggaccaggacttgctgggactgctcacccggatcttctgacctcagatataggtttggcggttaaagacgctgatgtgatactgattgtagtgccggccatccaccacgcttccattgcagcaaatatcgccagttacatttccgagggtcagttgattatccttaaccctggggcaacgggtggagcgctggaattccggaaaatcctgcgtgaaaatggtgcgccggaggtaacgatcggggaaacctcaagtatgctctttacatgccgctccgagagaccaggacaggttacggtaaatgcgataacacgtgccatggactttgcatgtctcccagcggcaaaagctggatgggccctggaacagatagggtcggttcttcctcaataccaggctgtcgaaaacgtgttgcatacttcgctgactaatatcgaagctgtattgcacccgctgccaacactgttaaacgctgctcgttgtgagtctggtaccccattccattattataccgaggggattacgccatcagtcggggcgcttgcggagaaagtggacgctgaacgcatagcaatcgcaaaggctttcgatttaaacgttccgtcggtctgcgaatgggttaagattagttacggccagtcaccggccacaatttatgaagcggtgcagggtaatcctgctctgcgcggcattatgggacctaccagccttaacacggtgcacttcttcgaggatgtaagcaccggactggtaccgttatccgaactgggtcgggcagtgaatgtgcctaccccacttatcgatgctgttcttctgttgatcagttcgctgatagacgtggatttcagaaaggaaggtcgtaccttggaaaaattaggtctgagcggacttaccgccgcggaaataagaagtgctgttgag

SEQ ID NO: 448 - protein, 359 aa, Artificial Sequence
  Engineered variant of opine dehydrogenase CENDH
MIESKTYAVLGLGNGGHAFAAYLALKGQRVLAWDIDAQRIKEIQDRGAIIAEGPGLAGTAHPDLLTSDIGLAVKDADVILIVVPAIHHASIAANIASYISEGQLIILNPGATGGALEFRKILRENGAPEVTIGETSSMLFTCRSERPGQVTVNAITRAMDFACLPAAKAGWALEQIGSVLPQYQAVENVLHTSLTNIEAVLHPLPTLLNAARCESGTPFHYYTEGITPSVGALAEKVDAERIAIAKAFDLNVPSVCEWVKISYGQSPATIYEAVQGNPALRGIMGPTSLNTVHFFEDVSTGLVPLSELGRAVNVPTPLIDAVLLLISSLIDVDFRKEGRTLEKLGLSGLTAAEIRSAVE

SEQ ID NO: 449 - DNA, 1077 bp, Artificial Sequence
  Engineered variant of opine dehydrogenase CENDH
atgatcgagtcaaaaacatacgccgttttgggattaggaccagggggtcacgcatttgccgcctatttagcattgaagggccagcgtgtactggcttgggacatcgatgctcagagaatcaaagagattcaggaccgtggagccatcatagcggaaggaccaggacttgctgggactgctcacccggatcttctgacctcagatataggtttggcggttaaagacgctgatgtgatactgattgtagtgccggccatccaccacgcttccattgcagcaaatatcgccagttacatttccgagggtcagttgattatccttaaccctggggcaacgggtggagcgctggaattccggaaaatcctgcgtgaaaatggtgcgccggaggtaacgatcggggaaacctcaagtatgctctttacatgccgctccgagagaccaggacaggttacggtaaatgcgataacacgtgccatggactttgcatgtctcccagcggcaaaagctggatgggccctggaacagatagggtcggttcttcctcaataccaggctgtcgaaaacgtgttgcatacttcgctgactaatatcgaagctgtattgcacccgctgccaacactgttaaacgctgctcgttgtgagtctggtaccccattccattattataccgaggggattacgccatcagtcggggcgcttgcggagaaagtggacgctgaacgcatagcaatcgcaaaggctttcgatttaaacgttccgtcggtctgcgaatggcataagattagttacggccagtcaccggccacaatttatgaagcggtgcagggtaatcctgctctgcgcggcattatgggacctaccagccttaacacggtgcacttcttcgaggatgtaagcaccggactggtaccgttatccgaactgggtcgggcagtgaatgtgcctaccccacttatcgatgctgttcttctgttgatcagttcgctgatagacgtggatttcagaaaggaaggtcgtaccttggaaaaattaggtctgagcggacttaccgccgcggaaataagaagtgctgttgag

SEQ ID NO: 450 - protein, 359 aa, Artificial Sequence
  Engineered variant of opine dehydrogenase CENDH
MIESKTYAVLGLGPGGHAFAAYLALKGQRVLAWDIDAQRIKEIQDRGAIIAEGPGLAGTAHPDLLTSDIGLAVKDADVILIVVPAIHHASIAANIASYISEGQLIILNPGATGGALEFRKILRENGAPEVTIGETSSMLFTCRSERPGQVTVNAITRAMDFACLPAAKAGWALEQIGSVLPQYQAVENVLHTSLTNIEAVLHPLPTLLNAARCESGTPFHYYTEGITPSVGALAEKVDAERIAIAKAFDLNVPSVCEWHKISYGQSPATIYEAVQGNPALRGIMGPTSLNTVHFFEDVSTGLVPLSELGRAVNVPTPLIDAVLLLISSLIDVDFRKEGRTLEKLGLSGLTAAEIRSAVE

SEQ ID NO: 451 - DNA, 1077 bp, Artificial Sequence
  Engineered variant of opine dehydrogenase CENDH
atgatcgagtcaaaaacatacgccgttttgggattaggaaacgggggtcacgcatttgccgcctatttagcattgaagggccagcgtgtactggcttgggacatcgatgctcagagaatcaaagagattcaggaccgtggagccatcatagcggaaggaccaggacttgctgggactgctcacccggatcttctgacctcagatataggtttggcggttaaagacgctgatgtgatactgattgtagtgccggccatccaccacgcttccattgcagcaaaaatcgccagttacatttccgagggtcagttgattatccttaaccctggggcaacgggtggagcgctggaattccggaaaatcctgcgtgaaaatggtgcgccggaggtaacgatcggggaaacctcaagtatgctctttacatgccgctccgagagaccaggacaggttacggtaaatgcgataacactggccatggactttgcatgtctcccagcggcaaaagctggatgggccctggaacagatagggtcggttcttcctcaatgccaggctgtcgaaaacgtgttgcatacttcgctgactaatatcgaagctgtattgcacccgctgccaacactgttaaacgctgctcgttgtgagtctggtaccccattccattattataccgaggggattacgccatcagtcggggcgcttgcggagaaagtggacgctgaacgcatagcaatcgcaaaggctttcgatttaaacgttccgtcggtctgcgaatggcataagattagttacggccagtcaccggccacaatttatgaagcggtgcagggtaatcctgctctgcgcggcattatgggacctaccagccttaacacggtgcacttcttcgaggatgtaagcaccggactggtaccgttatccgaactgggtcgggcagtgaatgtgcctaccccacttatcgatgctgttcttctgttgatcagttcgctgatagacgtggatttcagaaaggaaggtcgtaccttggaaaaattaggtctgagcggacttaccgccgcggaaataagaagtgctgttgag

SEQ ID NO: 452 - protein, 359 aa, Artificial Sequence
  Engineered variant of opine dehydrogenase CENDH
MIESKTYAVLGLGNGGHAFAAYLALKGQRVLAWDIDAQRIKEIQDRGAIIAEGPGLAGTAHPDLLTSDIGLAVKDADVILIVVPAIHHASIAAKIASYISEGQLIILNPGATGGALEFRKILRENGAPEVTIGETSSMLFTCRSERPGQVTVNAITLAMDFACLPAAKAGWALEQIGSVLPQCQAVENVLHTSLTNIEAVLHPLPTLLNAARCESGTPFHYYTEGITPSVGALAEKVDAERIAIAKAFDLNVPSVCEWHKISYGQSPATIYEAVQGNPALRGIMGPTSLNTVHFFEDVSTGLVPLSELGRAVNVPTPLIDAVLLLISSLIDVDFRKEGRTLEKLGLSGLTAAEIRSAVE

SEQ ID NO: 453 - DNA, 1077 bp, Artificial Sequence
  Engineered variant of opine dehydrogenase CENDH
atgatcgagtcaaaaacatacgccgttttgggattaggaaacgggggtcacgcatttgccgcctatttagcattgaagggccagcgtgtactggcttgggacatcgatgctcagagaatcaaagagattcaggaccgtggagccatcatagcggaaggaccaggacttgctgggactgctcacccggatcttctgacctcagatataggtttggcggttaaagacgctgatgtgatactgattgtagtgccggccatccaccacgcttccattgcagcaaaaatcgccagttacatttccgagggtcagttgattatccttaaccctggggcaacgggtggagcgctggaattccggaaaatcctgcgtgaaaatggtgcgccggaggtaacgatcggggaaacctcaagtatgctctttacatgccgctccgagagaccaggacaggttacggtaaattatataacacgtgccatggactttgcatgtctcccagcggcaaaagctggatgggccctggaacagatagggtcggttcttcctcaataccaggctgtcgaaaacgtgttgcatacttcgctgactaatatcgaagctgtattgcacccgctgccaacactgttaaacgctgctcgttgtgagtctggtaccccattccattattataccgaggggattacgccatcagtcggggcgcttgcggagaaagtggacgctgaacgcatagcaatcgcaaaggctttcgatttaaacgttccgtcggtctgcgaatggcataagattagttacggccagtcaccggccacaatttatgaagcggtgcagggtaatcctgctctgcgcggcattatgggacctaccagccttaacacggtgcacttcttcgaggatgtaagcaccggactggtaccgttatccgaactgggtcgggcagtgaatgtgcctaccccacttatcgatgctgttgtgctgttgatcagttcgctgatagacgtggatttcagaaaggaaggtcgtaccttggaaaaattaggtctgagcggacttaccgccgcggaaataagaagtgctgttgag

SEQ ID NO: 454 - protein, 359 aa, Artificial Sequence
  Engineered variant of opine dehydrogenase CENDH
MIESKTYAVLGLGNGGHAFAAYLALKGQRVLAWDIDAQRIKEIQDRGAIIAEGPGLAGTAHPDLLTSDIGLAVKDADVILIVVPAIHHASIAAKIASYISEGQLIILNPGATGGALEFRKILRENGAPEVTIGETSSMLFTCRSERPGQVTVNYITRAMDFACLPAAKAGWALEQIGSVLPQYQAVENVLHTSLTNIEAVLHPLPTLLNAARCESGTPFHYYTEGITPSVGALAEKVDAERIAIAKAFDLNVPSVCEWHKISYGQSPATIYEAVQGNPALRGIMGPTSLNTVHFFEDVSTGLVPLSELGRAVNVPTPLIDAVVLLISSLIDVDFRKEGRTLEKLGLSGLTAAEIRSAVE

SEQ ID NO: 455 - DNA, 1077 bp, Artificial Sequence
  Engineered variant of opine dehydrogenase CENDH
atgatcgagtcaaaaacatacgccgttttgggattaggaaacgggggtcacgcatttgccgcctatttagcattgaagggccagcgtgtactggcttgggacatcgatgctcagagaatcaaagagattcaggaccgtggagccatcatagcggaaggaccaggacttgctgggactgctcacccggatcttctgacctcagatataggtttggcggttaaagacgctgatgtgatactgattgtagtgccggccatccaccacgcttccattgcagcaaatatcgccagttacatttccgagggtcagttgattatccttaaccctggggcaacgggtggagcgctggaattccggaaaatcctgcgtgaaaatggtgcgccggaggtaacgatcggggaaacctcaagtatgctctttacatgccgctccgagagaccaggacaggttacggtaaatcagataacacgtgccatggactttgcatgtctcccagcggcaaaagctggatgggccctggaacagatacattcggttcttcctcaataccaggctgtcgaaaacgtgttgcatacttcgctgactaatatcgaagctgtattgcacccgctgccaacactgttaaacgctgctcgttgtgagtctggtaccccattccattattataccgaggggattacgccatcagtcgggcgtcttgcggagaaagtggacgctgaacgcatagcaatcgcaaaggctttcgatttaaacgttccgtcggtcgtggaatggcataagattagttacggccagtcaccggccacaatttatgaagcggtgcagggtaatcctgctctgcgcggcattatgggacctaccagccttaacacggtgcacttcttcgaggatgtaagcaccggactggtaccgttatccgaactgggtcgggtggtgaatgtgcctaccccacttatcgatgctgtttgcctgttgatcagtgaactgatagacgtggatttcagaaaggaaggtcgtaccttggaaaaattaggtctgagcggacttaccgccgcggaaataagaagtgctgttgag

SEQ ID NO: 456 - protein, 359 aa, Artificial Sequence
  Engineered variant of opine dehydrogenase CENDH
MIESKTYAVLGLGNGGHAFAAYLALKGQRVLAWDIDAQRIKEIQDRGAIIAEGPGLAGTAHPDLLTSDIGLAVKDADVILIVVPAIHHASIAANIASYISEGQLIILNPGATGGALEFRKILRENGAPEVTIGETSSMLFTCRSERPGQVTVNQITRAMDFACLPAAKAGWALEQIHSVLPQYQAVENVLHTSLTNIEAVLHPLPTLLNAARCESGTPFHYYTEGITPSVGRLAEKVDAERIAIAKAFDLNVPSVVEWHKISYGQSPATIYEAVQGNPALRGIMGPTSLNTVHFFEDVSTGLVPLSELGRVVNVPTPLIDAVCLLISELIDVDFRKEGRTLEKLGLSGLTAAEIRSAVE

SEQ ID NO: 457 - DNA, 1077 bp, Artificial Sequence
  Engineered variant of opine dehydrogenase CENDH
atgatcgagtcaaaaacatacgccgttttgggattaggaaacgggggtcacgcatttgccgcctatttagcattgaagggccagaccgtactggcttgggacatcgatcatcagagaatcaaagagattcaggaccgtggagccatcatagcggaaggaccaggacttgctgggactgctcacccggatcttctgacctcagatataggtttggcggttaaagacgctgatgtgatactgattgtagtgccggccatccaccacgcttccattgcagcaaatatcgccagttacatttccgagggtcagttgattatccttaaccctggggcaacgggtggagcgctggaattccggaaaatcctgcgtgaaaatggtgcgccggaggtaacgatcggggaaacctcaagtatgctctttacatgccgctccgagagaccaggacaggttacggtaaatcagataacccgtgccatggactttgcatgtctcccagcggcaaaagctggatgggccctggaacagatagggtcggttcttcctcaataccaggctgtcgaaaacgtgttgcatacttcgctgactaatatcgaagctgtattgcacccgctgccaacactgttaaacgctgctcgttgtgagtctggtaccccattccattattataccgaggggattacgccatcagtcgggcgtcttgcggagaaagtggacgctgaacgcatagcaatcgcaaaggctttcgatttaaacgttccgtcggtctgcgaatggcataagattagttacggccagtcaccggccacaatttatgaagcggtgcagggtaatcctgctctgcgcggcattatgggacctaccagccttaacacggtgcacttcttcgaggatgtaagcaccggactggtaccgttatccgaactgggtcgggtggtgaatgtgcctaccccacttatcgatgctgttcttctgttgatcagtgcgctgatagacgtggatttcagaaaggaaggtcgtaccttggaaaaattaggtctgagcggacttaccgccgcggaaataagaagtgctgttgag

SEQ ID NO: 458 - protein, 359 aa, Artificial Sequence
  Engineered variant of opine dehydrogenase CENDH
MIESKTYAVLGLGNGGHAFAAYLALKGQTVLAWDIDHQRIKEIQDRGAIIAEGPGLAGTAHPDLLTSDIGLAVKDADVILIVVPAIHHASIAANIASYISEGQLIILNPGATGGALEFRKILRENGAPEVTIGETSSMLFTCRSERPGQVTVNQITRAMDFACLPAAKAGWALEQIGSVLPQYQAVENVLHTSLTNIEAVLHPLPTLLNAARCESGTPFHYYTEGITPSVGRLAEKVDAERIAIAKAFDLNVPSVCEWHKISYGQSPATIYEAVQGNPALRGIMGPTSLNTVHFFEDVSTGLVPLSELGRVVNVPTPLIDAVLLLISALIDVDFRKEGRTLEKLGLSGLTAAEIRSAVE

SEQ ID NO: 459 - DNA, 1077 bp, Artificial Sequence; identical to SEQ ID NO: 353
  Engineered variant of opine dehydrogenase CENDH

SEQ ID NO: 460 - protein, 359 aa, Artificial Sequence; identical to SEQ ID NO: 354
  Engineered variant of opine dehydrogenase CENDH

SEQ ID NO: 461 - DNA, 1077 bp, Artificial Sequence
  Engineered variant of opine dehydrogenase CENDH
atgatcgagtcaaaaacatacgccgttttgggattaggaaacgggggtcacgcatttgccgcctatttagcattgaagggccagcgtgtactggcttgggacatcgatgctcagagaatcaaagagattcaggaccgtggagccatcatagcggaaggaccaggacttgctgggactgctcacccggatcttctgacctcagatataggtttggcggttaaagacgctgatgtgatactgattgtagtgccggccatccaccacgcttccattgcagcaaatatcgccagttacatttccgagggtcagttgattatccttaaccctggggcaacgggtggagcgctggaattccggaaaatcctgcgtgaaaatggtgcgccggaggtaacgatcggggaaacctcaagtatgctctttacatgccgctccgagagaccaggacaggttacggtaaatgcgataacacgtgccatggactttgcatgtctcccagcggcaaaagctggatgggccctggaacagatagggtcggttcttcctcaataccaggctgtcgaaaacgtgttgcatacttcgctgactaatatcgaagctgtattgcacccgctgccaacactgttaaacgctgctcgttgtgagtctggtaccccattccattattataccgaggggattacgccatcagtcggggcgcttgcggagaaagtggacgctgaacgcatagcaatcgcaaaggctttcgatttaaacgttccgtcggtctgcgaatggcataagattagttacggccagtcaccggccacaatttatgaagcggtgcagggtaatccttatctgcgcggcattatgggacctaccagccttaacacggtgcacttcttcgaggatgtaagcaccggactggtaccgttatccgaactgggtcgggcagtgaatgtgcctaccccacttatcgatgctgttcttctgttgatcagttcgctgatagacgtggatttcagaaaggaaggtcgtaccttggaaaaattaggtctgagcggacttaccgccgcggaaataagaagtgctgttgag

SEQ ID NO: 462 - protein, 359 aa, Artificial Sequence
  Engineered variant of opine dehydrogenase CENDH
MIESKTYAVLGLGNGGHAFAAYLALKGQRVLAWDIDAQRIKEIQDRGAIIAEGPGLAGTAHPDLLTSDIGLAVKDADVILIVVPAIHHASIAANIASYISEGQLIILNPGATGGALEFRKILRENGAPEVTIGETSSMLFTCRSERPGQVTVNAITRAMDFACLPAAKAGWALEQIGSVLPQYQAVENVLHTSLTNIEAVLHPLPTLLNAARCESGTPFHYYTEGITPSVGALAEKVDAERIAIAKAFDLNVPSVCEWHKISYGQSPATIYEAVQGNPYLRGIMGPTSLNTVHFFEDVSTGLVPLSELGRAVNVPTPLIDAVLLLISSLIDVDFRKEGRTLEKLGLSGLTAAEIRSAVE

SEQ ID NO: 463 - DNA, 1077 bp, Artificial Sequence
  Engineered variant of opine dehydrogenase CENDH
atgatcgagtcaaaaacatacgccgttttgggattaggaaacgggggtcacgcatttgccgcctatttagcattgaagggccagcgtgtactggcttgggacatcgatgctcagagaatcaaagagattcaggaccgtggagccatcatagcggaaggaccaggacttgctgggactgctcacccggatcttctgacctcagatataggtttggcggttaaagacgctgatgtgatactgattgtagtgccggccatccaccacgcttccattgcagcaaaaatcgccagttacatttccgagggtcagttgattatccttaaccctggggcaacgggtggagcgctggaattccggaaaatcctgcgtgaaaatggtgcgccggaggtaacgatcggggaaacctcaagtatgctctttacatgccgctccgagagaccaggacaggttacggtaaattatataacactggccatggactttgcatgtctcccagcggcaaaagctggatgggccctggaacagatagggtcggttcttcctcaataccaggctgtcgaaaacgtgttgcatacttcgctgactaatatcgaagctgtattgcacccgctgccaacactgttaaacgctgctcgttgtgagtctggtaccccattccattattataccgaggggattacgccatcagtcggggcgcttgcggagaaagtggacgctgaacgcatagcaatcgcaaaggctttcgatttaaacgttccgtcggtctgcgaatggcataagattagttacggctattcaccggccacaatttatgaagcggtgcagggtaatcctgctctgcgcggcattatgggacctaccagccttaacacggtgcacttcttcgaggatgtaagcaccggactggtaccgttatccgaactgggtcgggcagtgaatgtgcctaccccacttatcgatgctgttcttctgttgatcagttcgctgatagacgtggatttcagaaaggaaggtcgtaccttggaaaaattaggtctgagcggacttaccgccgcggaaataagaagtgctgttgag

SEQ ID NO: 464 - protein, 359 aa, Artificial Sequence
  Engineered variant of opine dehydrogenase CENDH
MIESKTYAVLGLGNGGHAFAAYLALKGQRVLAWDIDAQRIKEIQDRGAIIAEGPGLAGTAHPDLLTSDIGLAVKDADVILIVVPAIHHASIAAKIASYISEGQLIILNPGATGGALEFRKILRENGAPEVTIGETSSMLFTCRSERPGQVTVNYITLAMDFACLPAAKAGWALEQIGSVLPQYQAVENVLHTSLTNIEAVLHPLPTLLNAARCESGTPFHYYTEGITPSVGALAEKVDAERIAIAKAFDLNVPSVCEWHKISYGYSPATIYEAVQGNPALRGIMGPTSLNTVHFFEDVSTGLVPLSELGRAVNVPTPLIDAVLLLISSLIDVDFRKEGRTLEKLGLSGLTAAEIRSAVE

SEQ ID NO: 465 - DNA, 1077 bp, Artificial Sequence
  Engineered variant of opine dehydrogenase CENDH
atgatcgagtcaaaaacatacgccgttttgggattaggaaacgggggtcacgcatttgccgcctatttagcattgaagggccagcgtgtactggcttgggacatcgatgctcagagaatcaaagagattcaggaccgtggagccatcatagcggaaggaccaggacttgctgggactgctcacccggatcttctgacctcagatataggtttggcggttaaagacgctgatgtgatactgattgtagtgccggccatccaccacgcttccattgcagcaaatatcgccagttacatttccgagggtcagttgattatccttaaccctggggcaacgggtggagcgctggaattccggaaaatcctgcgtgaaaatggtgcgccggaggtaacgatcggggaaacctcaagtatgctctttacatgccgctccgagagaccaggacaggttacggtaaatgcgataacacgtgccatggactttgcatgtctcccagcggcaaaagctggatgggccctggaacagatagggtcggttcttcctcaataccaggctgtcgaaaacgtgttgcatacttcgctgactaatatcgaagctgtattgcacccgctgccaacactgttaaacgctgctcgttgtgagtctggtaccccattccattattataccgaggggattacgccatcagtcggggcgcttgcggagaaagtggacgctgaacgcatagcaatcgcaaaggctttcgatttaaacgttccgtcggtctgcgaatggcataagattagttacggccagtcaccggccacaatttatgaagcggtgcagggtaatcctgttctgcgcggcattatgggacctaccagccttaacacggtgcacttcttcgaggatgtaagcaccggactggtaccgttatccgaactgggtcgggcagtgaatgtgcctaccccacttatcgatgctgttcttctgttgatcagttcgctgatagacgtggatttcagaaaggaaggtcgtaccttggaaaaattaggtctgagcggacttaccgccgcggaaataagaagtgctgttgag

SEQ ID NO: 466 - protein, 359 aa, Artificial Sequence
  Engineered variant of opine dehydrogenase CENDH
MIESKTYAVLGLGNGGHAFAAYLALKGQRVLAWDIDAQRIKEIQDRGAIIAEGPGLAGTAHPDLLTSDIGLAVKDADVILIVVPAIHHASIAANIASYISEGQLIILNPGATGGALEFRKILRENGAPEVTIGETSSMLFTCRSERPGQVTVNAITRAMDFACLPAAKAGWALEQIGSVLPQYQAVENVLHTSLTNIEAVLHPLPTLLNAARCESGTPFHYYTEGITPSVGALAEKVDAERIAIAKAFDLNVPSVCEWHKISYGQSPATIYEAVQGNPVLRGIMGPTSLNTVHFFEDVSTGLVPLSELGRAVNVPTPLIDAVLLLISSLIDVDFRKEGRTLEKLGLSGLTAAEIRSAVE

SEQ ID NO: 467 - DNA, 1077 bp, Artificial Sequence
  Engineered variant of opine dehydrogenase CENDH
atgatcgagtcaaaaacatacgccgttttgggattaggaaacgggggtcacgcatttgccgcctatttagcattgaagggccagcgtgtactggcttgggacatcgatgctcagagaatcaaagagattcaggaccgtggagccatcatagcggaaggaccaggacttgctgggactgctcacccggatcttctgacctcagatataggtttggcggttaaagacgctgatgtgatactgattgtagtgccggccatccaccacgcttccattgcagcaaatatcgccagttacatttccgagggtcagttgattatccttaaccctggggcaacgggtggagcgctggaattccggaaaatcctgcgtgaaaatggtgcgccggaggtaacgatcggggaaacctcaagtatgctctttacatgccgctccgagagaccaggacaggttacggtaaatatgataacacgtgccatggactttgcatgtctcccagcggcaaaagctggatgggccctggaacagatacattcggttcttcctcaataccaggctgtcgaaaacgtgttgcatacttcgctgactaatatcgaagctgtattgcacccgctgccaacactgttaaacgctgctcgttgtgagtctggtaccccattccattattataccgaggggattacgccatcagtcgggcgtcttgcggagaaagtggacgctgaacgcatagcaatcgcaaaggctttcgatttaaacgttccgtcggtctgcgaatggcataagattagttacggccagtcaccggccacaatttatgaagcggtgcagggtaatcctgctctgcgcggcattatgggacctaccagccttaacacggtgcacttcttcgaggatgtaagcaccggactggtaccgttatccgaactgggtcgggtggtgaatgtgcctaccccacttatcgatgctgttcttctgttgatcagttcgctgatagacgtggatttcagaaaggaaggtcgtaccttggaaaaattaggtctgagcggacttaccgccgcggaaataagaagtgctgttgag

SEQ ID NO: 468 - protein, 359 aa, Artificial Sequence
  Engineered variant of opine dehydrogenase CENDH
MIESKTYAVLGLGNGGHAFAAYLALKGQRVLAWDIDAQRIKEIQDRGAIIAEGPGLAGTAHPDLLTSDIGLAVKDADVILIVVPAIHHASIAANIASYISEGQLIILNPGATGGALEFRKILRENGAPEVTIGETSSMLFTCRSERPGQVTVNMITRAMDFACLPAAKAGWALEQIHSVLPQYQAVENVLHTSLTNIEAVLHPLPTLLNAARCESGTPFHYYTEGITPSVGRLAEKVDAERIAIAKAFDLNVPSVCEWHKISYGQSPATIYEAVQGNPALRGIMGPTSLNTVHFFEDVSTGLVPLSELGRVVNVPTPLIDAVLLLISSLIDVDFRKEGRTLEKLGLSGLTAAEIRSAVE

SEQ ID NO: 469 - DNA, 1077 bp, Artificial Sequence
  Engineered variant of opine dehydrogenase CENDH
atgatcgagctgaaaacatacgccgttttgggattaggaaacgggggtcacgcatttgccgcctatttagcattgaagggccagcgtgtactggcttgggacatcgatgctcagagaatcaaagagattcaggaccgtggagccatcatagcggaaggaccaggacttgctgggactgctcacccggatcttctgacctcagatataggtttggcggttaaagacgctgatgtgatactgattgtagtgccggccatccaccacgcttccattgcagcaaaaatcgccagttacatttccgagggtcagttgattatccttaaccctggggcaacgggtggagcgctggaattccggaaaatcctgcgtgaaaatggtgcgccggaggtaacgatcggggaaacctcaagtatgctctttacatgccgctccgagagaccaggacaggttacggtaaatgcgataacacgtgccatggactttgcatgtctcccagcggcaaaagctggatgggccctggaacagatagggtcggttcttcctcaatgccaggctgtcgaaaacgtgttgcatacttcgctgactaatatcgaagctgtattgcacccgctgccaacactgttaaacgctgctcgttgtgagtctggtaccccattccattattataccgaggggattacgccatcagtcggggcgcttgcggagaaagtggacgctgaacgcatagcaatcgcaaaggctttcgatttaaacgttccgtcggtctgcgaatggcataagattagttacggccagtcaccggccacaatttatgaagcggtgcagggtaatcctgctctgcgcggcattatgggacctaccagccttaacacggtgcacttcttcgaggatgtaagcaccggactggtaccgttatccgaactgggtcgggcagtgaatgtgcctaccccacttatcgatgctgttcttctgttgatcagttcgctgatagacgtggatttcagaaaggaaggtcgtaccttggaaaaattaggtctgagcggacttaccgccgcggaaataagaagtgctgttgag

SEQ ID NO: 470 - protein, 359 aa, Artificial Sequence
  Engineered variant of opine dehydrogenase CENDH
MIELKTYAVLGLGNGGHAFAAYLALKGQRVLAWDIDAQRIKEIQDRGAIIAEGPGLAGTAHPDLLTSDIGLAVKDADVILIVVPAIHHASIAAKIASYISEGQLIILNPGATGGALEFRKILRENGAPEVTIGETSSMLFTCRSERPGQVTVNAITRAMDFACLPAAKAGWALEQIGSVLPQCQAVENVLHTSLTNIEAVLHPLPTLLNAARCESGTPFHYYTEGITPSVGALAEKVDAERIAIAKAFDLNVPSVCEWHKISYGQSPATIYEAVQGNPALRGIMGPTSLNTVHFFEDVSTGLVPLSELGRAVNVPTPLIDAVLLLISSLIDVDFRKEGRTLEKLGLSGLTAAEIRSAVE

SEQ ID NO: 471 - DNA, 1077 bp, Artificial Sequence
  Engineered variant of opine dehydrogenase CENDH
atgatcgagtcaaaaacatacgccgttttgggattaggaaacgggggtcacgcatttgccgcctatttagcattgaagggccagcgtgtactggcttgggacatcgatgctcagagaatcaaagagattcaggaccgtggagccatcatagcggaaggaccaggacttgctgggactgctcacccggatcttctgacctcagatataggtttggcggttaaagacgctgatgtgatactgattgtagtgccggccatccaccacgcttccattgcagcaaatatcgccagttacatttccgagggtcagttgattatccttaaccctggggcaacgggtggagcgctggaattccggaaaatcctgcgtgaaaatggtgcgccggaggtaacgatcggggaaacctcaagtatgctctttacatgccgctccgagagaccaggacaggttacggtaaatgcgataacacgtgccatggactttgcatgtctcccagcggcaaaagctggatgggccctggaacagatagggtcggttcttcctcaataccaggctgtcgaaaacgtgttgcatacttcgctgactaatatcgaagctgtattgcacccgctgccaacactgttaaacgctgctcgttgtgagtctggtaccccattccattattataccgaggggattacgccatcagtcggggcgcttgcggagaaagtggacgctgaacgcatagcaatcgcaaaggctttcgatttaaacgttccgtcggtctgcgaatggcataagattagttacggccagtcaccggccacaatttatgaagcggtgcagggtaatccttttctgcgcggcattatgggacctaccagccttaacacggtgcacttcttcgaggatgtaagcaccggactggtaccgttatccgaactgggtcgggcagtgaatgtgcctaccccacttatcgatgctgttcttctgttgatcagttcgctgatagacgtggatttcagaaaggaaggtcgtaccttggaaaaattaggtctgagcggacttaccgccgcggaaataagaagtgctgttgag

SEQ ID NO: 472 - protein, 359 aa, Artificial Sequence
  Engineered variant of opine dehydrogenase CENDH
MIESKTYAVLGLGNGGHAFAAYLALKGQRVLAWDIDAQRIKEIQDRGAIIAEGPGLAGTAHPDLLTSDIGLAVKDADVILIVVPAIHHASIAANIASYISEGQLIILNPGATGGALEFRKILRENGAPEVTIGETSSMLFTCRSERPGQVTVNAITRAMDFACLPAAKAGWALEQIGSVLPQYQAVENVLHTSLTNIEAVLHPLPTLLNAARCESGTPFHYYTEGITPSVGALAEKVDAERIAIAKAFDLNVPSVCEWHKISYGQSPATIYEAVQGNPFLRGIMGPTSLNTVHFFEDVSTGLVPLSELGRAVNVPTPLIDAVLLLISSLIDVDFRKEGRTLEKLGLSGLTAAEIRSAVE

SEQ ID NO: 473 - DNA, 1077 bp, Artificial Sequence
  Engineered variant of opine dehydrogenase CENDH
atgatcgagtcaaaaacatacgccgttttgggattaggaaacgggggtcacgcatttgccgcctatttagcattgaagggccagcgtgtactggcttgggacatcgatgctcagagaatcaaagagattcaggaccgtggagccatcatagcggaaggaccaggacttgctgggactgctcacccggatcttctgacctcagatataggtttggcggttaaagacgctgatgtgatactgattgtagtgccggccatccaccacgcttccattgcagcaaatatcgccagttacatttccgagggtcagttgattatccttaaccctgggcgtacgggtggagcgctggaattccggaaaatcctgcgtgaaaatggtgcgccggaggtaacgatcggggaaacctcaagtatgctctttacatgccgctccgagagaccaggacaggttacggtaaatgcgataacacgtgccatggactttgcatgtctcccagcggcaaaagctggatgggccctggaacagatagggtcggttcttcctcaataccaggctgtcgaaaacgtgttgcatacttcgctgactaatatcgaagctgtattgcacccgctgccaacactgttaaacgctgctcgttgtgagtctggtaccccattccattattataccgaggggattacgccatcagtcggggcgcttgcggagaaagtggacgctgaacgcatagcaatcgcaaaggctttcgatttaaacgttccgtcggtctgcgaatggcataagattagttacggccagtcaccggccacaatttatgaagcggtgcagggtaatcctgctctgcgcggcattatgggacctaccagccttaacacggtgcacttcttcgaggatgtaagcaccggactggtaccgttatccgaactgggtcgggcagtgaatgtgcctaccccacttatcgatgctgttcttctgttgatcagttcgctgatagacgtggatttcagaaaggaaggtcgtaccttggaaaaattaggtctgagcggacttaccgccgcggaaataagaagtgctgttgag

SEQ ID NO: 474 - protein, 359 aa, Artificial Sequence
  Engineered variant of opine dehydrogenase CENDH
MIESKTYAVLGLGNGGHAFAAYLALKGQRVLAWDIDAQRIKEIQDRGAIIAEGPGLAGTAHPDLLTSDIGLAVKDADVILIVVPAIHHASIAANIASYISEGQLIILNPGRTGGALEFRKILRENGAPEVTIGETSSMLFTCRSERPGQVTVNAITRAMDFACLPAAKAGWALEQIGSVLPQYQAVENVLHTSLTNIEAVLHPLPTLLNAARCESGTPFHYYTEGITPSVGALAEKVDAERIAIAKAFDLNVPSVCEWHKISYGQSPATIYEAVQGNPALRGIMGPTSLNTVHFFEDVSTGLVPLSELGRAVNVPTPLIDAVLLLISSLIDVDFRKEGRTLEKLGLSGLTAAEIRSAVE

SEQ ID NO: 475 - DNA, 1077 bp, Artificial Sequence
  Engineered variant of opine dehydrogenase CENDH
atgatcgagtcaaaaacatacgccgttttgggattaggaaacgggggtcacgcatttgccgcctatttagcattgaagggccagcgtgtactggcttgggacatcgatgctcagagaatcaaagagattcaggaccgtggagccatcatagcggaaggaccaggacttgctgggactgctcacccggatcttctgacctcagatataggtttggcggttaaagacgctgatgtgatactgattgtagtgccggccatccaccacgcttccattgcagcaaaaatcgccagttacatttccgagggtcagttgattatccttaaccctggggcaacgggtggagcgctggaattccggaaaatcctgcgtgaaaatggtgcgccggaggtaacgatcggggaaacctcaagtatgctctttacatgccgctccgagagaccaggacaggttacggtaaatgcgataacacgtgccatggactttgcatgtctcccagcggcaaaagctggatgggccctggaacagatagggtcggttcttcctcaatgccaggctgtcgaaaacgtgttgcatacttcgctgactaatatcgaagctgtattgcacccgctgccaacactgttaaacgctgctcgttgtgagtctggtaccccattccattattataccgaggggattacgccatcagtcggggcgcttgcggagaaagtggacgctgaacgcatagcaatcgcaaaggctttcgatttaaacgttccgtcggtctgcgaatggcataagattagttacggcctgtcaccggccacaatttatgaagcggtgcagggtaatcctgctctgcgcggcattatgggacctaccagccttaacacggtgcacttcttcgaggatgtaagcaccggactggtaccgttatccgaactgggtcgggcagtgaatgtgcctaccccacttatcgatgctgttcttctgttgatcagttcgctgatagacgtggatttcagaaaggaaggtcgtaccttggaaaaattaggtctgagcggacttaccgccgcggaaataagaagtgctgttgag

SEQ ID NO: 476 - protein, 359 aa, Artificial Sequence
  Engineered variant of opine dehydrogenase CENDH
MIESKTYAVLGLGNGGHAFAAYLALKGQRVLAWDIDAQRIKEIQDRGAIIAEGPGLAGTAHPDLLTSDIGLAVKDADVILIVVPAIHHASIAAKIASYISEGQLIILNPGATGGALEFRKILRENGAPEVTIGETSSMLFTCRSERPGQVTVNAITRAMDFACLPAAKAGWALEQIGSVLPQCQAVENVLHTSLTNIEAVLHPLPTLLNAARCESGTPFHYYTEGITPSVGALAEKVDAERIAIAKAFDLNVPSVCEWHKISYGLSPATIYEAVQGNPALRGIMGPTSLNTVHFFEDVSTGLVPLSELGRAVNVPTPLIDAVLLLISSLIDVDFRKEGRTLEKLGLSGLTAAEIRSAVE

SEQ ID NO: 477 - DNA, 1077 bp, Artificial Sequence
  Engineered variant of opine dehydrogenase CENDH
atgatcgagtcaaaaacatacgccgttttgggattaggaaacgggggtcacgcatttgccgcctatttagcattgaagggccagcgtgtactggcttgggacatcgatgctcagagaatcaaagagattcaggaccgtggagccatcatagcggaaggaccaggacttgctgggactgctcacccggatcttctgacctcagatataggtttggcggttaaagacgctgatgtgatactgattgtagtgccggccatccaccacgcttccattgcagcaaatatcgccagttacatttccgagggtcagttgattatccttaaccctggggcaacgggtggagcgctggaattccggaaaatcctgcgtctgaatggtgcgccggaggtaacgatcggggaaacctcaagtatgctctttacatgccgctccgagagaccaggacaggttacggtaaattttatgacacgtgccatggactttgcatgtctcccagcggcaaaagctggatgggccctggaacagatagggtcggttcttcctcaataccaggctgtcgaaaacgtgttgcatacttcgctgactaatatcgaagctgtattgcacccgctgccaacactgttaaacgctgctcgttgtgagtctggtaccccattccattattataccgaggggattacgccatcagtcgggcgtcttgcggagaaagtggacgctgaacgcatagcaatcgcaaaggctttcgatttaaacgttccgtcggtctgcgaatggcataagattagttacggccagtcaccggccacaatttatgaagcggtgcagggtaatcctgctctgcgcggcattatgggacctaccagccttaacacggtgcacttcttcgaggatgtaagcaccggactggtaccgttatccgaactgggtcggaccgtgaatgtgcctaccccacttatcgatgctgttcttctgttgatcagttcgctgatagacgtggatttcagaaaggaaggtcgtaccttggaaaaattaggtctgagcggacttaccgccgcggaaataagaagtgctgttgag

SEQ ID NO: 478 - protein, 359 aa, Artificial Sequence
  Engineered variant of opine dehydrogenase CENDH
MIESKTYAVLGLGNGGHAFAAYLALKGQRVLAWDIDAQRIKEIQDRGAIIAEGPGLAGTAHPDLLTSDIGLAVKDADVILIVVPAIHHASIAANIASYISEGQLIILNPGATGGALEFRKILRLNGAPEVTIGETSSMLFTCRSERPGQVTVNFMTRAMDFACLPAAKAGWALEQIGSVLPQYQAVENVLHTSLTNIEAVLHPLPTLLNAARCESGTPFHYYTEGITPSVGRLAEKVDAERIAIAKAFDLNVPSVCEWHKISYGQSPATIYEAVQGNPALRGIMGPTSLNTVHFFEDVSTGLVPLSELGRTVNVPTPLIDAVLLLISSLIDVDFRKEGRTLEKLGLSGLTAAEIRSAVE

SEQ ID NO: 479 - DNA, 1077 bp, Artificial Sequence
  Engineered variant of opine dehydrogenase CENDH
atgatcgagtcaaaaacatacgccgttttgggattaggaaacgggggtcacgcatttgccgcctatttagcattgaagggccagcgtgtactggcttgggacatcgatcatcagagaatcaaagagattcaggaccgtggagccatcatagcggaaggaccaggacttgctgggactgctcacccggatcttctgacctcagatataggtttggcggttaaagacgctgatgtgatactgattgtagtgccggccatccaccacgcttccattgcagcaaatatcgccagttacatttccgagggtcagttgattatccttaaccctggggcaacgggtggagcgctggaattccggaaaatcctgcgtaacaatggtgcgccggaggtaacgatcggggaaacctcaagtatgctctttacatgccgctccgagagaccaggacaggttacggtaaattttatgacacgtgccatggactttgcatgtctcccagcggcaaaagctggatgggccctggaacagatacattcggttcttcctcaataccaggctgtcgaaaacgtgttgcatacttcgctgactaatatcgaagctgtattgcacccgctgccaacactgttaaacgctgctcgttgtgagtctggtaccccattccattattataccgaggggattacgccatcagtcggggcgcttgcggagaaagtggacgctgaacgcatagcaatcgcaaaggctttcgatttaaacgttccgtcggtctgcgaatggcataagattagttacggccagtcaccggccacaatttatgaagcggtgcagggtaatcctgctctgcgcggcattatgggacctaccagccttaacacggtgcacttcttcgaggatgtaagcaccggactggtaccgttatccgaactgggtcgggtggtgaatgtgcctaccccacttatcgatgctgtttgcctgttgatcagtgaactgatagacgtggatttcagaaaggaaggtcgtaccttggaaaaattaggtctgagcggacttaccgccgcggaaataagaagtgctgttgag

SEQ ID NO: 480 - protein, 359 aa, Artificial Sequence
  Engineered variant of opine dehydrogenase CENDH
MIESKTYAVLGLGNGGHAFAAYLALKGQRVLAWDIDHQRIKEIQDRGAIIAEGPGLAGTAHPDLLTSDIGLAVKDADVILIVVPAIHHASIAANIASYISEGQLIILNPGATGGALEFRKILRNNGAPEVTIGETSSMLFTCRSERPGQVTVNFMTRAMDFACLPAAKAGWALEQIHSVLPQYQAVENVLHTSLTNIEAVLHPLPTLLNAARCESGTPFHYYTEGITPSVGALAEKVDAERIAIAKAFDLNVPSVCEWHKISYGQSPATIYEAVQGNPALRGIMGPTSLNTVHFFEDVSTGLVPLSELGRVVNVPTPLIDAVCLLISELIDVDFRKEGRTLEKLGLSGLTAAEIRSAVE

SEQ ID NO: 481 - DNA, 1077 bp, Artificial Sequence
  Engineered variant of opine dehydrogenase CENDH
atgatcgagtcaaaaacatacgccgttttgggattaggaaacgggggtcacgcatttgccgcctatttagcattgaagggccagcgtgtactggcttgggacatcgatgctcagagaatcaaagagattcaggaccgtggagccatcatagcggaaggaccaggacttgctgggactgctcacccggatcttctgacctcagatataggtttggcggttaaagacgctgatgtgatactgattgtagtgccggccatccaccacgcttccattgcagcaaatatcgccagttacatttccgagggtcagttgattatccttaaccctggggcaacgggtggagcgctggaattccggaaaatcctgcgtaacaatggtgcgccggaggtaacgatcggggaaacctcaagtatgctctttacatgccgctccgagagaccaggacaggttacggtaaatgcgatgacacgtgccatggactttgcatgtctcccagcggcaaaagctggatgggccctggaacagatagggtcggttcttcctcaataccaggctgtcgaaaacgtgttgcatacttcgctgactaatatcgaagctgtattgcacccgctgccaacactgttaaacgctgctcgttgtgagtctggtaccccattccattattataccgaggggattacgccatcagtcggggcgcttgcggagaaagtggacgctgaacgcatagcaatcgcaaaggctttcgatttaaacgttccgtcggtctgcgaatggcataagattagttacggccagtcaccggccacaatttatgaagcggtgcagggtaatcctgctctgcgcggcattatgggacctaccagccttaacacggtgcacttcttcgaggatgtaagcaccggactggtaccgttatccgaactgggtcgggcagtgaatgtgcctaccccacttatcgatgctgttcttctgttgatcagtgaactgatagacgtggatttcagaaaggaaggtcgtaccttggaaaaattaggtctgagcggacttaccgccgcggaaataagaagtgctgttgag

SEQ ID NO: 482 - protein, 359 aa, Artificial Sequence
  Engineered variant of opine dehydrogenase CENDH
MIESKTYAVLGLGNGGHAFAAYLALKGQRVLAWDIDAQRIKEIQDRGAIIAEGPGLAGTAHPDLLTSDIGLAVKDADVILIVVPAIHHASIAANIASYISEGQLIILNPGATGGALEFRKILRNNGAPEVTIGETSSMLFTCRSERPGQVTVNAMTRAMDFACLPAAKAGWALEQIGSVLPQYQAVENVLHTSLTNIEAVLHPLPTLLNAARCESGTPFHYYTEGITPSVGALAEKVDAERIAIAKAFDLNVPSVCEWHKISYGQSPATIYEAVQGNPALRGIMGPTSLNTVHFFEDVSTGLVPLSELGRAVNVPTPLIDAVLLLISELIDVDFRKEGRTLEKLGLSGLTAAEIRSAVE

SEQ ID NO: 483 - DNA, 1077 bp, Artificial Sequence
  Engineered variant of opine dehydrogenase CENDH
atgatcgagtcaaaaacatacgccgttttgggattaggaaacgggggtcacgcatttgccgcctatttagcattgaagggccagcgtgtactggcttgggacatcgatgctcagagaatcaaagagattcaggaccgtggagccatcatagcggaaggaccaggacttgctgggactgctcacccggatcttctgacctcagatataggtttggcggttaaagacgctgatgtgatactgattgtagtgccggccatccaccacgcttccattgcagcaaaaatcgccagttacatttccgagggtcagttgattatccttaaccctggggcaacgggtggagcgctggaattccggaaaatcctgcgtgaaaatggtgcgccggaggtaacgatcggggaaacctcaagtatgctctttacatgccgctccgagagaccaggacaggttacggtaaatgcgataacacgtgccatggactttgcatgtctcccagcggcaaaagctggatgggccctggaacagatagggtcggttcttcctcaatgccaggctgtcgaaaacgtgttgcatacttcgctgactaatatcgaagctgtattgcacccgctgccaacactgttaaacgctgctcgttgtgagtctggtaccccattccattattataccgaggggattacgccatcagtcggggcgcttgcggagaaagtggacgctgaacgcatagcaatcgcaaaggctttcgatttaaacgttccgtcggtctgcgaatggcataagattagttacggcctgtcaccggccacaatttatgaagcggtgcagggtaatcctgctctgcgcggcattatgggacctaccagccttaacacggtgcacgcgttcgaggatgtaagcaccggactggtaccgttatccgaatttggtcgggcagtgaatgtgcctaccccacttatcgatgctgttcttctgttgatcagttcgctgatagacgtggatttcagaaaggaaggtcgtaccttggaaaaattaggtctgagcggacttaccgccgcggaaataagaagtgctgttgag

SEQ ID NO: 484 - protein, 359 aa, Artificial Sequence
  Engineered variant of opine dehydrogenase CENDH
MIESKTYAVLGLGNGGHAFAAYLALKGQRVLAWDIDAQRIKEIQDRGAIIAEGPGLAGTAHPDLLTSDIGLAVKDADVILIVVPAIHHASIAAKIASYISEGQLIILNPGATGGALEFRKILRENGAPEVTIGETSSMLFTCRSERPGQVTVNAITRAMDFACLPAAKAGWALEQIGSVLPQCQAVENVLHTSLTNIEAVLHPLPTLLNAARCESGTPFHYYTEGITPSVGALAEKVDAERIAIAKAFDLNVPSVCEWHKISYGLSPATIYEAVQGNPALRGIMGPTSLNTVHAFEDVSTGLVPLSEFGRAVNVPTPLIDAVLLLISSLIDVDFRKEGRTLEKLGLSGLTAAEIRSAVE

SEQ ID NO: 485 - DNA, 1077 bp, Artificial Sequence
  Engineered variant of opine dehydrogenase CENDH
atgatcgagtcaaaaacatacgccgttttgggattaggaaacgggggtcacgcatttgccgcctatttagcattgaagggccagcgtgtactggcttgggacatcgatgctcagagaatcaaagagattcaggaccgtggagccatcatagcggaaggaccaggacttgctgggactgctcacccggatcttctgacctcagatataggtttggcggttaaagacgctgatgtgatactgattgtagtgccggccatccaccacgcttccattgcagcaaaaatcgccagttacatttccgagggtcagttgattatccttaaccctggggcaacgggtggagcgctggaattccggaaaatcctgcgtgaaaatggtgcgccggaggtaacgatcggggaaacctcaagtatgctctttacatgccgctccgagagaccaggacaggttacggtaaatgcgataacactggccatggactttgcatgtctcccagcggcaaaagctggatgggccctggaacagatagggtcggttcttcctcaataccaggctgtcgaaaacgtgttgcatacttcgctgactaatatcgaagctgtattgcacccgctgccaacactgttaaacgctgctcgttgtgagtctggtaccccattccattattataccgaggggattacgccatcagtcggggcgcttgcggagaaagtggacgctgaacgcatagcaatcgcaaaggctttcgatttaaacgttccgtcggtctgcgaatggcataagattagttacggctattcaccggccacaatttatgaagcggtgcagggtaatcctgctctgcgcggcattatgggacctaccagccttaacacggtgcacttcttcgaggatgtaagcaccggactggtaccgttatccgaactgggtcgggcagtgaatgtgcctaccccacttatcgatgctgttcttctgttgatcagttcgctgatagacgtggatttcagaaaggaaggtcgtaccttggaaaaattaggtctgagcggacttaccgccgcggaaataagaagtgctgttgag

SEQ ID NO: 486 - protein, 359 aa, Artificial Sequence
  Engineered variant of opine dehydrogenase CENDH
MIESKTYAVLGLGNGGHAFAAYLALKGQRVLAWDIDAQRIKEIQDRGAIIAEGPGLAGTAHPDLLTSDIGLAVKDADVILIVVPAIHHASIAAKIASYISEGQLIILNPGATGGALEFRKILRENGAPEVTIGETSSMLFTCRSERPGQVTVNAITLAMDFACLPAAKAGWALEQIGSVLPQYQAVENVLHTSLTNIEAVLHPLPTLLNAARCESGTPFHYYTEGITPSVGALAEKVDAERIAIAKAFDLNVPSVCEWHKISYGYSPATIYEAVQGNPALRGIMGPTSLNTVHFFEDVSTGLVPLSELGRAVNVPTPLIDAVLLLISSLIDVDFRKEGRTLEKLGLSGLTAAEIRSAVE

SEQ ID NO: 487 - DNA, 1077 bp, Artificial Sequence
  Engineered variant of opine dehydrogenase CENDH
atgatcgagtcaaaaacatacgccgttttgggattaggaaacgggggtcacgcatttgccgcctatttagcattgaagggccagcgtgtactggcttgggacatcgatgctcagagaatcaaagagattcaggaccgtggagccatcatagcggaaggaccaggacttgctgggactgctcacccggatcttctgacctcagatataggtttggcggttaaagacgctgatgtgatactgattgtagtgccggccatccaccacgcttccattgcagcacgtatcgccagttacatttccgagggtcagttgattatccttaaccctggggcaacgggtggagcgctggaattccggaaaatcctgcgtgaaaatggtgcgccggaggtaacgatcggggaaacctcaagtatgctctttacatgccgctccgagagaccaggacaggttacggtaaatgcgataacacgtgccatggactttgcatgtctcccagcggcaaaagctggatgggccctggaacagatagggtcggttcttcctcaataccaggctgtcgaaaacgtgttgcatacttcgctgactaatatcgaagctgtattgcacccgctgccaacactgttaaacgctgctcgttgtgagtctggtaccccattccattattataccgaggggattacgccatcagtcggggcgcttgcggagaaagtggacgctgaacgcatagcaatcgcaaaggctttcgatttaaacgttccgtcggtctgcgaatggcataagattagttacggccagtcaccggccacaatttatgaagcggtgcagggtaatcctgctctgcgcggcattatgggacctaccagccttaacacggtgcacttcttcgaggatgtaagcaccggactggtaccgttatccgaactgggtcgggcagtgaatgtgcctaccccacttatcgatgctgttcttctgttgatcagttcgctgatagacgtggatttcagaaaggaaggtcgtaccttggaaaaattaggtctgagcggacttaccgccgcggaaataagaagtgctgttgag

SEQ ID NO: 488 - protein, 359 aa, Artificial Sequence
  Engineered variant of opine dehydrogenase CENDH
MIESKTYAVLGLGNGGHAFAAYLALKGQRVLAWDIDAQRIKEIQDRGAIIAEGPGLAGTAHPDLLTSDIGLAVKDADVILIVVPAIHHASIAARIASYISEGQLIILNPGATGGALEFRKILRENGAPEVTIGETSSMLFTCRSERPGQVTVNAITRAMDFACLPAAKAGWALEQIGSVLPQYQAVENVLHTSLTNIEAVLHPLPTLLNAARCESGTPFHYYTEGITPSVGALAEKVDAERIAIAKAFDLNVPSVCEWHKISYGQSPATIYEAVQGNPALRGIMGPTSLNTVHFFEDVSTGLVPLSELGRAVNVPTPLIDAVLLLISSLIDVDFRKEGRTLEKLGLSGLTAAEIRSAVE

SEQ ID NO: 489 - DNA, 1077 bp, Artificial Sequence
  Engineered variant of opine dehydrogenase CENDH
atgatcgagtcaaaaacatacgccgttttgggattaggaaacgggggtcacgcatttgccgcctatttagcattgaagggccagcgtgtactggcttgggacatcgatgctcagagaatcaaagagattcaggaccgtggagccatcatagcggaaggaccaggacttgctgggactgctcacccggatcttctgacctcagatataggtttggcggttaaagacgctgatgtgatactgattgtagtgccggccatccaccacgcttccattgcagcaaaaatcgccagttacatttccgagggtcagttgattatccttaaccctggggcaacgggtggagcgctggaattccggaaaatcctgcgtgaaaatggtgcgccggaggtaacgatcggggaaacctcaagtatgctctttacatgccgctccgagagaccaggacaggttacggtaaatgcgataacactggccatggactttgcatgtctcccagcggcaaaagctggatgggccctggaacagatagggtcggttcttcctcaatgccaggctgtcgaaaacgtgttgcatacttcgctgactaatatcgaagctgtattgcacccgctgccaacactgttaaacgctgctcgttgtgagtctggtaccccattccattattataccgaggggattacgccatcagtcggggcgcttgcggagaaagtggacgctgaacgcatagcaatcgcaaaggctttcgatttaaacgttccgtcggtctgcgaatggcataagattagttacggcggctcaccggccacaatttatgaagcggtgcagggtaatcctgctctgcgcggcattatgggacctaccagccttaacacggtgcacttcttcgaggatgtaagcaccggactggtaccgttatccgaactgggtcgggcagtgaatgtgcctaccccacttatcgatgctgttcttctgttgatcagttcgctgatagacgtggatttcagaaaggaaggtcgtaccttggaaaaattaggtctgagcggacttaccgccgcggaaataagaagtgctgttgag

SEQ ID NO: 490 - protein, 359 aa, Artificial Sequence
  Engineered variant of opine dehydrogenase CENDH
MIESKTYAVLGLGNGGHAFAAYLALKGQRVLAWDIDAQRIKEIQDRGAIIAEGPGLAGTAHPDLLTSDIGLAVKDADVILIVVPAIHHASIAAKIASYISEGQLIILNPGATGGALEFRKILRENGAPEVTIGETSSMLFTCRSERPGQVTVNAITLAMDFACLPAAKAGWALEQIGSVLPQCQAVENVLHTSLTNIEAVLHPLPTLLNAARCESGTPFHYYTEGITPSVGALAEKVDAERIAIAKAFDLNVPSVCEWHKISYGGSPATIYEAVQGNPALRGIMGPTSLNTVHFFEDVSTGLVPLSELGRAVNVPTPLIDAVLLLISSLIDVDFRKEGRTLEKLGLSGLTAAEIRSAVE

SEQ ID NO: 491 - DNA, 1077 bp, Artificial Sequence
  Engineered variant of opine dehydrogenase CENDH
atgatcgagtcaaaaacatacgccgttttgggattaggaaacgggggtcacgcatttgccgcctatttagcattgaagggccagcgtgtactggcttgggacatcgatgctcagagaatcaaagagattcaggaccgtggagccatcatagcggaaggaccaggacttgctgggactgctcacccggatcttctgacctcagatataggtttggcggttaaagacgctgatgtgatactgattgtagtgccggccatccaccacgcttccattgcagcaaatatcgccagttacatttccgagggtcagttgattatccttaaccctggggcaacgggtggagcgctggaattccggaaaatcctgcgtctgaatggtgcgccggaggtaacgatcggggaaacctcaagtatgctctttacatgccgctccgagagaccaggacaggttacggtaaatgcgatgacacgtgccatggactttgcatgtctcccagcggcaaaagctggatgggccctggaacagatagggtcggttcttcctcaataccaggctgtcgaaaacgtgttgcatacttcgctgactaatatcgaagctgtattgcacccgctgccaacactgttaaacgctgctcgttgtgagtctggtaccccattccattattataccgaggggattacgccatcagtcggggcgcttgcggagaaagtggacgctgaacgcatagcaatcgcaaaggctttcgatttaaacgttccgtcggtctgcgaatggcataagattagttacggccagtcaccggccacaatttatgaagcggtgcagggtaatcctgctctgcgcggcattatgggacctaccagccttaacacggtgcacttcttcgaggatgtaagcaccggactggtaccgttatccgaactgggtcggaccgtgaatgtgcctaccccacttatcgatgctgttcttctgttgatcagttcgctgatagacgtggatttcagaaaggaaggtcgtaccttggaaaaattaggtctgagcggacttaccgccgcggaaataagaagtgctgttgag

SEQ ID NO: 492 - protein, 359 aa, Artificial Sequence
  Engineered variant of opine dehydrogenase CENDH
MIESKTYAVLGLGNGGHAFAAYLALKGQRVLAWDIDAQRIKEIQDRGAIIAEGPGLAGTAHPDLLTSDIGLAVKDADVILIVVPAIHHASIAANIASYISEGQLIILNPGATGGALEFRKILRLNGAPEVTIGETSSMLFTCRSERPGQVTVNAMTRAMDFACLPAAKAGWALEQIGSVLPQYQAVENVLHTSLTNIEAVLHPLPTLLNAARCESGTPFHYYTEGITPSVGALAEKVDAERIAIAKAFDLNVPSVCEWHKISYGQSPATIYEAVQGNPALRGIMGPTSLNTVHFFEDVSTGLVPLSELGRTVNVPTPLIDAVLLLISSLIDVDFRKEGRTLEKLGLSGLTAAEIRSAVE

SEQ ID NO: 493 - DNA, 1077 bp, Artificial Sequence
  Engineered variant of opine dehydrogenase CENDH
atgatcgagtcaaaaacatacgccgttttgggattaggaaacgggggtcacgcatttgccgcctatttagcattgaagggccagcgtgtactggcttgggacatcgatgctcagagaatcaaagagattcaggaccgtggagccatcatagcggaaggaccaggacttgctgggactgctcacccggatcttctgacctcagatataggtttggcggttaaagacgctgatgtgatactgattgtagtgccggccatccaccacgcttccattgcagcaaatatcgccagttacatttccgagggtcagttgattatccttaaccctggggcaacgggtggagcgctggaattccggaaaatcctgcgtgaaaatggtgcgccggaggtaacgatcggggaaacctcaagtatgctctttacatgccgctccgagagaccaggacaggttacggtaaatgcgataacacgtgccatggactttgcatgtctcccagcggcaaaagctggatgggccctggaacagatagggtcggttcttcctcaataccaggctgtcgaaaacgtgttgcatacttcgctgactaatatcgaagctgtattgcacccgctgccaacactgttaaacgctgctcgttgtgagtctggtaccccattccattattataccgaggggattacgccatcagtcggggcgcttgcggagaaagtggacgctgaacgcatagcaatcgcaaaggctttcgatttaaacgttccgtcggtctgcgaatggcataagattagttacggccagtcaccggccacaatttatgaagcggtgcagggtaatcctgctctgcgcggcattatgggacctaccagccttaacacggtgcacttcttcgaggcagtaagcaccggactggtaccgttatccgaactgggtcgggcagtgaatgtgcctaccccacttatcgatgctgttcttctgttgatcagttcgctgatagacgtggatttcagaaaggaaggtcgtaccttggaaaaattaggtctgagcggacttaccgccgcggaaataagaagtgctgttgag

SEQ ID NO: 494 - protein, 359 aa, Artificial Sequence
  Engineered variant of opine dehydrogenase CENDH
MIESKTYAVLGLGNGGHAFAAYLALKGQRVLAWDIDAQRIKEIQDRGAIIAEGPGLAGTAHPDLLTSDIGLAVKDADVILIVVPAIHHASIAANIASYISEGQLIILNPGATGGALEFRKILRENGAPEVTIGETSSMLFTCRSERPGQVTVNAITRAMDFACLPAAKAGWALEQIGSVLPQYQAVENVLHTSLTNIEAVLHPLPTLLNAARCESGTPFHYYTEGITPSVGALAEKVDAERIAIAKAFDLNVPSVCEWHKISYGQSPATIYEAVQGNPALRGIMGPTSLNTVHFFEAVSTGLVPLSELGRAVNVPTPLIDAVLLLISSLIDVDFRKEGRTLEKLGLSGLTAAEIRSAVE

SEQ ID NO: 495 - DNA, 1077 bp, Artificial Sequence
  Engineered variant of opine dehydrogenase CENDH
atgatcgagtcaaaaacatacgccgttttgggattaggaaacgggggtcacgcatttgccgcctatttagcattgaagggccagcgtgtactggcttgggacatcgatgctcagagaatcaaagagattcaggaccgtggagccatcatagcggaaggaccaggacttgctgggactgctcacccggatcttctgacctcagatataggtttggcggttaaagacgctgatgtgatactgattgtagtgccggccatccaccacgcttccattgcagcaaatatcgccagttacatttccgagggtcagttgattatccttaaccctggggcaacgggtggagcgctggaattccggaaaatcctgcgtgaaaatggtgcgccggaggtaacgatcggggaaacctcaagtatgctctttacatgccgctccgagagaccaggacaggttacggtaaatcagataacacgtgccatggactttgcatgtctcccagcggcaaaagctggatgggccctggaacagatagggtcggttcttcctcaataccaggctgtcgaaaacgtgttgcatacttcgctgactaatatcgaagctgtattgcacccgctgccaacactgttaaacgctgctcgttgtgagtctggtaccccattccattattataccgaggggattacgccatcagtcggggcgcttgcggagaaagtggacgctgaacgcatagcaatcgcaaaggctttcgatttaaacgttccgtcggtctgcgaatggcataagattagttacggccagtcaccggccacaatttatgaagcggtgcagggtaatcctgctctgcgcggcattatgggacctaccagccttaacacggtgcacttcttcgaggatgtaagcaccggactggtaccgttatccgaactgggtcggaccgtgaatgtgcctaccccacttatcgatgctgttcttctgttgatcagttcgctgatagacgtggatttcagaaaggaaggtcgtaccttggaaaaattaggtctgagcggacttaccgccgcggaaataagaagtgctgttgag

SEQ ID NO: 496 - protein, 359 aa, Artificial Sequence
  Engineered variant of opine dehydrogenase CENDH
MIESKTYAVLGLGNGGHAFAAYLALKGQRVLAWDIDAQRIKEIQDRGAIIAEGPGLAGTAHPDLLTSDIGLAVKDADVILIVVPAIHHASIAANIASYISEGQLIILNPGATGGALEFRKILRENGAPEVTIGETSSMLFTCRSERPGQVTVNQITRAMDFACLPAAKAGWALEQIGSVLPQYQAVENVLHTSLTNIEAVLHPLPTLLNAARCESGTPFHYYTEGITPSVGALAEKVDAERIAIAKAFDLNVPSVCEWHKISYGQSPATIYEAVQGNPALRGIMGPTSLNTVHFFEDVSTGLVPLSELGRTVNVPTPLIDAVLLLISSLIDVDFRKEGRTLEKLGLSGLTAAEIRSAVE

SEQ ID NO: 497 - DNA, 1077 bp, Artificial Sequence
  Engineered variant of opine dehydrogenase CENDH
atgatcgagtcaaaaacatacgccgttttgggattaggaaacgggggtcacgcatttgccgcctatttagcattgaagggccagcgtgtactggcttgggacatcgatgctcagagaatcaaagagattcaggaccgtggagccatcatagcggaaggaccaggacttgctgggactgctcacccggatcttctgacctcagatataggtttggcggttaaagacgctgatgtgatactgattgtagtgccggccatccaccacgcttccattgcagcaaatatcgccagttacatttccgagggtcagttgattatccttaaccctggggcaacgggtggagcgctggaattccggaaaatcctgcgtgaaaatggtgcgccggaggtaacgatcggggaaacctcaagtatgctctttacatgccgctccgagagaccaggacaggttacggtaaattttatgacacgtgccatggactttgcatgtctcccagcggcaaaagctggatgggccctggaacagatacattcggttcttcctcaataccaggctgtcgaaaacgtgttgcatacttcgctgactaatatcgaagctgtattgcacccgctgccaacactgttaaacgctgctcgttgtgagtctggtaccccattccattattataccgaggggattacgccatcagtcggggcgcttgcggagaaagtggacgctgaacgcatagcaatcgcaaaggctttcgatttaaacgttccgtcggtctgcgaatggcataagattagttacggccagtcaccggccacaatttatgaagcggtgcagggtaatcctgctctgcgcggcattatgggacctaccagccttaacacggtgcacttcttcgaggatgtaagcaccggactggtaccgttatccgaactgggtcgggcagtgaatgtgcctaccccacttatcgatgctgttcttctgttgatcagttcgctgatagacgtggatttcagaaaggaaggtcgtaccttggaaaaattaggtctgagcggacttaccgccgcggaaataagaagtgctgttgag

SEQ ID NO: 498 - protein, 359 aa, Artificial Sequence
  Engineered variant of opine dehydrogenase CENDH
MIESKTYAVLGLGNGGHAFAAYLALKGQRVLAWDIDAQRIKEIQDRGAIIAEGPGLAGTAHPDLLTSDIGLAVKDADVILIVVPAIHHASIAANIASYISEGQLIILNPGATGGALEFRKILRENGAPEVTIGETSSMLFTCRSERPGQVTVNFMTRAMDFACLPAAKAGWALEQIHSVLPQYQAVENVLHTSLTNIEAVLHPLPTLLNAARCESGTPFHYYTEGITPSVGALAEKVDAERIAIAKAFDLNVPSVCEWHKISYGQSPATIYEAVQGNPALRGIMGPTSLNTVHFFEDVSTGLVPLSELGRAVNVPTPLIDAVLLLISSLIDVDFRKEGRTLEKLGLSGLTAAEIRSAVE

SEQ ID NO: 499 - DNA, 1077 bp, Artificial Sequence
  Engineered variant of opine dehydrogenase CENDH
atgatcgagtcaaaaacatacgccgttttgggattaggaaacgggggtcacgcatttgccgcctatttagcattgaagggccagcgtgtactggcttgggacatcgatgctcagagaatcaaagagattcaggaccgtggagccatcatagcggaaggaccaggacttgctgggactgctcacccggatcttctgacctcagatataggtttggcggttaaagacgctgatgtgatactgattgtagtgccggccatccaccacgcttccattgcagcaaatatcgccagttacatttccgagggtcagttgattatccttaaccctggggcaacgggtggagcgctggaattccggaaaatcctgcgtgaaaatggtgcgccggaggtaacgatcggggaaacctcaagtatgctctttacatgccgctccgagagaccaggacaggttacggtaaattttataacacgtgccatggactttgcatgtctcccagcggcaaaagctggatgggccctggaacagatagggtcggttcttcctcaataccaggctgtcgaaaacgtgttgcatacttcgctgactaatatcgaagctgtattgcacccgctgccaacactgttaaacgctgctcgttgtgagtctggtaccccattccattattataccgaggggattacgccatcagtcgggcgtcttgcggagaaagtggacgctgaacgcatagcaatcgcaaaggctttcgatttaaacgttccgtcggtctgcgaatggcataagattagttacggccagtcaccggccacaatttatgaagcggtgcagggtaatcctgctctgcgcggcattatgggacctaccagccttaacacggtgcacttcttcgaggatgtaagcaccggactggtaccgttatccgaactgggtcggtgcgtgaatgtgcctaccccacttatcgatgctgttcttctgttgatcagttcgctgatagacgtggatttcagaaaggaaggtcgtaccttggaaaaattaggtctgagcggacttaccgccgcggaaataagaagtgctgttgag

SEQ ID NO: 500 - protein, 359 aa, Artificial Sequence
  Engineered variant of opine dehydrogenase CENDH
MIESKTYAVLGLGNGGHAFAAYLALKGQRVLAWDIDAQRIKEIQDRGAIIAEGPGLAGTAHPDLLTSDIGLAVKDADVILIVVPAIHHASIAANIASYISEGQLIILNPGATGGALEFRKILRENGAPEVTIGETSSMLFTCRSERPGQVTVNFITRAMDFACLPAAKAGWALEQIGSVLPQYQAVENVLHTSLTNIEAVLHPLPTLLNAARCESGTPFHYYTEGITPSVGRLAEKVDAERIAIAKAFDLNVPSVCEWHKISYGQSPATIYEAVQGNPALRGIMGPTSLNTVHFFEDVSTGLVPLSELGRCVNVPTPLIDAVLLLISSLIDVDFRKEGRTLEKLGLSGLTAAEIRSAVE

SEQ ID NO: 501 - DNA, 1077 bp, Artificial Sequence
  Engineered variant of opine dehydrogenase CENDH
atgatcgagtcaaaaacatacgccgttttgggattaggaaacgggggtcacgcatttgccgcctatttagcattgaagggccagcgtgtactggcttgggacatcgatcatcagagaatcaaagagattcaggaccgtggagccatcatagcggaaggaccaggacttgctgggactgctcacccggatcttctgacctcagatataggtttggcggttaaagacgctgatgtgatactgattgtagtgccggccatccaccacgcttccattgcagcaaatatcgccagttacatttccgagggtcagttgattatccttaaccctggggcaacgggtggagcgctggaattccggaaaatcctgcgtgaaaatggtgcgccggaggtaacgatcggggaaacctcaagtatgctctttacatgccgctccgagagaccaggacaggttacggtaaattttatgacacgtgccatggactttgcatgtctcccagcggcaaaagctggatgggccctggaacagatagggtcggttcttcctcaataccaggctgtcgaaaacgtgttgcatacttcgctgactaatatcgaagctgtattgcacccgctgccaacactgttaaacgctgctcgttgtgagtctggtaccccattccattattataccgaggggattacgccatcagtcgggcgtcttgcggagaaagtggacgctgaacgcatagcaatcgcaaaggctttcgatttaaacgttccgtcggtcgtggaatggcataagattagttacggccagtcaccggccacaatttatgaagcggtgcagggtaatcctgctctgcgcggcattatgggacctaccagccttaacacggtgcacttcttcgaggatgtaagcaccggactggtaccgttatccgaactgggtcgggtggtgaatgtgcctaccccacttatcgatgctgttcttctgttgatcagtggcctgatagacgtggatttcagaaaggaaggtcgtaccttggaaaaattaggtctgagcggacttaccgccgcggaaataagaagtgctgttgag

SEQ ID NO: 502 - protein, 359 aa, Artificial Sequence
  Engineered variant of opine dehydrogenase CENDH
MIESKTYAVLGLGNGGHAFAAYLALKGQRVLAWDIDHQRIKEIQDRGAIIAEGPGLAGTAHPDLLTSDIGLAVKDADVILIVVPAIHHASIAANIASYISEGQLIILNPGATGGALEFRKILRENGAPEVTIGETSSMLFTCRSERPGQVTVNFMTRAMDFACLPAAKAGWALEQIGSVLPQYQAVENVLHTSLTNIEAVLHPLPTLLNAARCESGTPFHYYTEGITPSVGRLAEKVDAERIAIAKAFDLNVPSVVEWHKISYGQSPATIYEAVQGNPALRGIMGPTSLNTVHFFEDVSTGLVPLSELGRVVNVPTPLIDAVLLLISGLIDVDFRKEGRTLEKLGLSGLTAAEIRSAVE

SEQ ID NO: 503 - DNA, 1077 bp, Artificial Sequence
  Engineered variant of opine dehydrogenase CENDH
atgatcgagtcaaaaacatacgccgttttgggattaggaaacgggggtcacgcatttgccgcctatttagcattgaagggccagcgtgtactggcttgggacatcgatgctcagagaatcaaagagattcaggaccgtggagccatcatagcggaaggaccaggacttgctgggactgctcacccggatcttctgacctcagatataggtttggcggttaaagacgctgatgtgatactgattgtagtgccggccatccaccacgcttccattgcagcaaaaatcgccagttacatttccgagggtcagttgattatccttaaccctggggcaacgggtggagcgctggaattccggaaaatcctgcgtgaaaatggtgcgccggaggtaacgatcggggaaacctcaagtatgctctttacatgccgctccgagagaccaggacaggttacggtaaatgcgataacaatggccatggactttgcatgtctcccagcggcaaaagctggatgggccctggaacagatagggtcggttcttcctcaataccaggctgtcgaaaacgtgttgcatacttcgctgactaatatcgaagctgtattgcacccgctgccaacactgttaaacgctgctcgttgtgagtctggtaccccattccattattataccgaggggattacgccatcagtcggggcgcttgcggagaaagtggacgctgaacgcatagcaatcgcaaaggctttcgatttaaacgttccgtcggtctgcgaatggcataagattagttacggcctgtcaccggccacaatttatgaagcggtgcagggtaatcctgctctgcgcggcattatgggacctaccagccttaacacggtgcacttcttcgaggatgtaagcaccggactggtaccgttatccgaatttggtcgggcagtgaatgtgcctaccccacttatcgatgctgttcttctgttgatcagttcgctgatagacgtggatttcagaaaggaaggtcgtaccttggaaaaattaggtctgagcggacttaccgccgcggaaataagaagtgctgttgag

SEQ ID NO: 504 - protein, 359 aa, Artificial Sequence
  Engineered variant of opine dehydrogenase CENDH
MIESKTYAVLGLGNGGHAFAAYLALKGQRVLAWDIDAQRIKEIQDRGAIIAEGPGLAGTAHPDLLTSDIGLAVKDADVILIVVPAIHHASIAAKIASYISEGQLIILNPGATGGALEFRKILRENGAPEVTIGETSSMLFTCRSERPGQVTVNAITMAMDFACLPAAKAGWALEQIGSVLPQYQAVENVLHTSLTNIEAVLHPLPTLLNAARCESGTPFHYYTEGITPSVGALAEKVDAERIAIAKAFDLNVPSVCEWHKISYGLSPATIYEAVQGNPALRGIMGPTSLNTVHFFEDVSTGLVPLSEFGRAVNVPTPLIDAVLLLISSLIDVDFRKEGRTLEKLGLSGLTAAEIRSAVE

SEQ ID NO: 505 - DNA, 1077 bp, Artificial Sequence
  Engineered variant of opine dehydrogenase CENDH
atgatcgagtcaaaaacatacgccgttttgggattaggaaacgggggtcacgcatttgccgcctatttagcattgaagggccagcgtgtactggcttgggacatcgatcatcagagaatcaaagagattcaggaccgtggagccatcatagcggaaggaccaggacttgctgggactgctcacccggatcttctgacctcagatataggtttggcggttaaagacgctgatgtgatactgattgtagtgccggccatccaccacgcttccattgcagcaaatatcgccagttacatttccgagggtcagttgattatccttaaccctggggcaacgggtggagcgctggaattccggaaaatcctgcgtctgaatggtgcgccggaggtaacgatcggggaaacctcaagtatgctctttacatgccgctccgagagaccaggacaggttacggtaaatcagatgacacgtgccatggactttgcatgtctcccagcggcaaaagctggatgggccctggaacagatagggtcggttcttcctcaataccaggctgtcgaaaacgtgttgcatacttcgctgactaatatcgaagctgtattgcacccgctgccaacactgttaaacgctgctcgttgtgagtctggtaccccattccattattataccgaggggattacgccatcagtcggggcgcttgcggagaaagtggacgctgaacgcatagcaatcgcaaaggctttcgatttaaacgttccgtcggtctgcgaatggcataagattagttacggccagtcaccggccacaatttatgaagcggtgcagggtaatcctgctctgcgcggcattatgggacctaccagccttaacacggtgcacttcttcgaggatgtaagcaccggactggtaccgttatccgaactgggtcgggtggtgaatgtgcctaccccacttatcgatgctgttcttctgttgatcagttcgctgatagacgtggatttcagaaaggaaggtcgtaccttggaaaaattaggtctgagcggacttaccgccgcggaaataagaagtgctgttgag

SEQ ID NO: 506 - protein, 359 aa, Artificial Sequence
  Engineered variant of opine dehydrogenase CENDH
MIESKTYAVLGLGNGGHAFAAYLALKGQRVLAWDIDHQRIKEIQDRGAIIAEGPGLAGTAHPDLLTSDIGLAVKDADVILIVVPAIHHASIAANIASYISEGQLIILNPGATGGALEFRKILRLNGAPEVTIGETSSMLFTCRSERPGQVTVNQMTRAMDFACLPAAKAGWALEQIGSVLPQYQAVENVLHTSLTNIEAVLHPLPTLLNAARCESGTPFHYYTEGITPSVGALAEKVDAERIAIAKAFDLNVPSVCEWHKISYGQSPATIYEAVQGNPALRGIMGPTSLNTVHFFEDVSTGLVPLSELGRVVNVPTPLIDAVLLLISSLIDVDFRKEGRTLEKLGLSGLTAAEIRSAVE

SEQ ID NO: 507 - DNA, 1077 bp, Artificial Sequence
  Engineered variant of opine dehydrogenase CENDH
atgatcgagtcaaaaacatacgccgttttgggattaggaaacgggggtcacgcatttgccgcctatttagcattgaagggccagcgtgtactggcttgggacatcgatgctcagagaatcaaagagattcaggaccgtggagccatcatagcggaaggaccaggacttgctgggactgctcacccggatcttctgacctcagatataggtttggcggttaaagacgctgatgtgatactgattgtagtgccggccatccaccacgcttccattgcagcaaatatcgccagttacatttccgagggtcagttgattatccttaaccctggggcaacgggtggagcgctggaattccggaaaatcctgcgtgaaaatggtgcgccggaggtaacgatcggggaaacctcaagtatgctctttacatgccgctccgagagaccaggacaggttacggtaaatatgataacacgtgccatggactttgcatgtctcccagcggcaaaagctggatgggccctggaacagatagggtcggttcttcctcaataccaggctgtcgaaaacgtgttgcatacttcgctgactaatatcgaagctgtattgcacccgctgccaacactgttaaacgctgctcgttgtgagtctggtaccccattccattattataccgaggggattacgccatcagtcgggcgtcttgcggagaaagtggacgctgaacgcatagcaatcgcaaaggctttcgatttaaacgttccgtcggtcgtggaatggcataagattagttacggccagtcaccggccacaatttatgaagcggtgcagggtaatcctgctctgcgcggcattatgggacctaccagccttaacacggtgcacttcttcgaggatgtaagcaccggactggtaccgttatccgaactgggtcgggtggtgaatgtgcctaccccacttatcgatgctgttcttctgttgatcagtgaactgatagacgtggatttcagaaaggaaggtcgtaccttggaaaaattaggtctgagcggacttaccgccgcggaaataagaagtgctgttgag

SEQ ID NO: 508 - protein, 359 aa, Artificial Sequence
  Engineered variant of opine dehydrogenase CENDH
MIESKTYAVLGLGNGGHAFAAYLALKGQRVLAWDIDAQRIKEIQDRGAIIAEGPGLAGTAHPDLLTSDIGLAVKDADVILIVVPAIHHASIAANIASYISEGQLIILNPGATGGALEFRKILRENGAPEVTIGETSSMLFTCRSERPGQVTVNMITRAMDFACLPAAKAGWALEQIGSVLPQYQAVENVLHTSLTNIEAVLHPLPTLLNAARCESGTPFHYYTEGITPSVGRLAEKVDAERIAIAKAFDLNVPSVVEWHKISYGQSPATIYEAVQGNPALRGIMGPTSLNTVHFFEDVSTGLVPLSELGRVVNVPTPLIDAVLLLISELIDVDFRKEGRTLEKLGLSGLTAAEIRSAVE

SEQ ID NO: 509 - DNA, 1077 bp, Artificial Sequence
  Engineered variant of opine dehydrogenase CENDH
atgatcgagtcaaaaacatacgccgttttgggattaggaaacgggggtcacgcatttgccgcctatttagcattgaagggccagcgtgtactggcttgggacatcgatgctcagagaatcaaagagattcaggaccgtggagccatcatagcggaaggaccaggacttgctgggactgctcacccggatcttctgacctcagatataggtttggcggttaaagacgctgatgtgatactgattgtagtgccggccatccaccacgcttccattgcagcaaatatcgccagttacatttccgagggtcagttgattatccttaaccctggggcaacgggtggagcgctggaattccggaaaatcctgcgtgaaaatggtgcgccggaggtaacgatcggggaaacctcaagtatgctctttacatgccgctccgagagaccaggacaggttacggtaaatgcgataacacgtgccatggactttgcatgtctcccagcggcaaaagctggatgggccctggaacagatagggtcggttcttcctcaataccaggctgtcgaaaacgtgttgcatacttcgctgactaatatcgaagctgtattgcacccgctgccaacactgttaaacgctgctcgttgtgagtctggtaccccattccattattataccgaggggattacgccatcagtcggggcgcttgcggagaaagtggacgctgaacgcatagcaatcgcaaaggctttcgatttaaacgttccgtcggtctgcgaagatcataagattagttacggccagtcaccggccacaatttatgaagcggtgcagggtaatcctgctctgcgcggcattatgggacctaccagccttaacacggtgcacttcttcgaggatgtaagcaccggactggtaccgttatccgaactgggtcgggcagtgaatgtgcctaccccacttatcgatgctgttcttctgttgatcagttcgctgatagacgtggatttcagaaaggaaggtcgtaccttggaaaaattaggtctgagcggacttaccgccgcggaaataagaagtgctgttgag

SEQ ID NO: 510 - protein, 359 aa, Artificial Sequence
  Engineered variant of opine dehydrogenase CENDH
MIESKTYAVLGLGNGGHAFAAYLALKGQRVLAWDIDAQRIKEIQDRGAIIAEGPGLAGTAHPDLLTSDIGLAVKDADVILIVVPAIHHASIAANIASYISEGQLIILNPGATGGALEFRKILRENGAPEVTIGETSSMLFTCRSERPGQVTVNAITRAMDFACLPAAKAGWALEQIGSVLPQYQAVENVLHTSLTNIEAVLHPLPTLLNAARCESGTPFHYYTEGITPSVGALAEKVDAERIAIAKAFDLNVPSVCEDHKISYGQSPATIYEAVQGNPALRGIMGPTSLNTVHFFEDVSTGLVPLSELGRAVNVPTPLIDAVLLLISSLIDVDFRKEGRTLEKLGLSGLTAAEIRSAVE

SEQ ID NO: 511 - DNA, 1077 bp, Artificial Sequence
  Engineered variant of opine dehydrogenase CENDH
atgatcgagtcaaaaacatacgccgttttgggattaggaaacgggggtcacgcatttgccgcctatttagcattgaagggccagcgtgtactggcttgggacatcgatgctcagagaatcaaagagattcaggaccgtggagccatcatagcggaaggaccaggacttgctgggactgctcacccggatcttctgacctcagatataggtttggcggttaaagacgctgatgtgatactgattgtagtgccggccatccaccacgcttccattgcagcaaaaatcgccagttacatttccgagggtcagttgattatccttaaccctggggcaacgggtggagcgctggaattccggaaaatcctgcgtgaaaatggtgcgccggaggtaacgatcggggaaacctcaagtatgctctttacatgccgctccgagagaccaggacaggttacggtaaatgcgataacaatggccatggactttgcatgtctcccagcggcaaaagctggatgggccctggaacagatagggtcggttcttcctcaataccaggctgtcgaaaacgtgttgcatacttcgctgactaatatcgaagctgtattgcacccgctgccaacactgttaaacgctgctcgttgtgagtctggtaccccattccattattataccgaggggattacgccatcagtcggggcgcttgcggagaaagtggacgctgaacgcatagcaatcgcaaaggctttcgatttaaacgttccgtcggtctgcgaatggcataagattagttacggcctgtcaccggccacaatttatgaagcggtgcagggtaatcctgctctgcgcggcattatgggacctaccagccttaacacggtgcacttcttcgaggatgtaagcaccggactggtaccgttatccgaactgggtcgggcagtgaatgtgcctaccccacttatcgatgctgttcttctgttgatcagttcgctgatagacgtggatttcagaaaggaaggtcgtaccttggaaaaattaggtctgagcggacttaccgccgcggaaataagaagtgctgttgag

SEQ ID NO: 512 - protein, 359 aa, Artificial Sequence
  Engineered variant of opine dehydrogenase CENDH
MIESKTYAVLGLGNGGHAFAAYLALKGQRVLAWDIDAQRIKEIQDRGAIIAEGPGLAGTAHPDLLTSDIGLAVKDADVILIVVPAIHHASIAAKIASYISEGQLIILNPGATGGALEFRKILRENGAPEVTIGETSSMLFTCRSERPGQVTVNAITMAMDFACLPAAKAGWALEQIGSVLPQYQAVENVLHTSLTNIEAVLHPLPTLLNAARCESGTPFHYYTEGITPSVGALAEKVDAERIAIAKAFDLNVPSVCEWHKISYGLSPATIYEAVQGNPALRGIMGPTSLNTVHFFEDVSTGLVPLSELGRAVNVPTPLIDAVLLLISSLIDVDFRKEGRTLEKLGLSGLTAAEIRSAVE

SEQ ID NO: 513 - DNA, 1077 bp, Artificial Sequence
  Engineered variant of opine dehydrogenase CENDH
atgatcgagtcaaaaacatacgccgttttgggattaggaaacgggggtcacgcatttgccgcctatttagcattgaagggccagcgtgtactggcttgggacatcgatgctcagagaatcaaagagattcaggaccgtggagccatcatagcggaaggaccaggacttgctgggactgctcacccggatcttctgacctcagatataggtttggcggttaaagacgctgatgtgatactgattgtagtgccggccatccaccacgcttccattgcagcacgtatcgccagttacatttccgagggtcagttgattatccttaaccctggggcaacgggtggagcgctggaattccggaaaatcctgcgtgaaaatggtgcgccggaggtaacgatcggggaaacctcaagtatgctctttacatgccgctccgagagaccaggacaggttacggtaaatgcgataacacgtgccatggactttgcatgtctcccagcggcaaaagctggatgggccctggaacagatagggtcggttcttcctcaatgccaggctgtcgaaaacgtgttgcatacttcgctgactaatatcgaagctgtattgcacccgctgccaacactgttaaacgctgctcgttgtgagtctggtaccccattccattattataccgaggggattacgccatcagtcggggcgcttgcggagaaagtggacgctgaacgcatagcaatcgcaaaggctttcgatttaaacgttccgtcggtctgcgaatggcataagattagttacggcggctcaccggccacaatttatgaagcggtgcagggtaatcctgctctgcgcggcattatgggacctaccagccttaacacggtgcacttcttcgaggatgtaagcaccggactggtaccgttatccgaactgggtcgggcagtgaatgtgcctaccccacttatcgatgctgttcttctgttgatcagttcgctgatagacgtggatttcagaaaggaaggtcgtaccttggaaaaattaggtctgagcggacttaccgccgcggaaataagaagtgctgttgag

SEQ ID NO: 514 - protein, 359 aa, Artificial Sequence
  Engineered variant of opine dehydrogenase CENDH
MIESKTYAVLGLGNGGHAFAAYLALKGQRVLAWDIDAQRIKEIQDRGAIIAEGPGLAGTAHPDLLTSDIGLAVKDADVILIVVPAIHHASIAARIASYISEGQLIILNPGATGGALEFRKILRENGAPEVTIGETSSMLFTCRSERPGQVTVNAITRAMDFACLPAAKAGWALEQIGSVLPQCQAVENVLHTSLTNIEAVLHPLPTLLNAARCESGTPFHYYTEGITPSVGALAEKVDAERIAIAKAFDLNVPSVCEWHKISYGGSPATIYEAVQGNPALRGIMGPTSLNTVHFFEDVSTGLVPLSELGRAVNVPTPLIDAVLLLISSLIDVDFRKEGRTLEKLGLSGLTAAEIRSAVE

SEQ ID NO: 515 - DNA, 1077 bp, Artificial Sequence
  Engineered variant of opine dehydrogenase CENDH
atgatcgagtcaaaaacatacgccgttttgggattaggaaacgggggtcacgcatttgccgcctatttagcattgaagggccagaccgtactggcttgggacatcgatgctcagagaatcaaagagattcaggaccgtggagccatcatagcggaaggaccaggacttgctgggactgctcacccggatcttctgacctcagatataggtttggcggttaaagacgctgatgtgatactgattgtagtgccggccatccaccacgcttccattgcagcaaatatcgccagttacatttccgagggtcagttgattatccttaaccctggggcaacgggtggagcgctggaattccggaaaatcctgcgtgaaaatggtgcgccggaggtaacgatcggggaaacctcaagtatgctctttacatgccgctccgagagaccaggacaggttacggtaaatgcgataacacgtgccatggactttgcatgtctcccagcggcaaaagctggatgggccctggaacagatagggtcggttcttcctcaataccaggctgtcgaaaacgtgttgcatacttcgctgactaatatcgaagctgtattgcacccgctgccaacactgttaaacgctgctcgttgtgagtctggtaccccattccattattataccgaggggattacgccatcagtcggggcgcttgcggagaaagtggacgctgaacgcatagcaatcgcaaaggctttcgatttaaacgttccgtcggtctgcgaatggcataagattagttacggccagtcaccggccacaatttatgaagcggtgcagggtaatcctgctctgcgcggcattatgggacctaccagccttaacacggtgcacttcttcgaggatgtaagcaccggactggtaccgttatccgaactgggtcgggcagtgaatgtgcctaccccacttatcgatgctgttcttctgttgatcagttcgctgatagacgtggatttcagaaaggaaggtcgtaccttggaaaaattaggtctgagcggacttaccgccgcggaaataagaagtgctgttgag

SEQ ID NO: 516 - protein, 359 aa, Artificial Sequence
  Engineered variant of opine dehydrogenase CENDH
MIESKTYAVLGLGNGGHAFAAYLALKGQTVLAWDIDAQRIKEIQDRGAIIAEGPGLAGTAHPDLLTSDIGLAVKDADVILIVVPAIHHASIAANIASYISEGQLIILNPGATGGALEFRKILRENGAPEVTIGETSSMLFTCRSERPGQVTVNAITRAMDFACLPAAKAGWALEQIGSVLPQYQAVENVLHTSLTNIEAVLHPLPTLLNAARCESGTPFHYYTEGITPSVGALAEKVDAERIAIAKAFDLNVPSVCEWHKISYGQSPATIYEAVQGNPALRGIMGPTSLNTVHFFEDVSTGLVPLSELGRAVNVPTPLIDAVLLLISSLIDVDFRKEGRTLEKLGLSGLTAAEIRSAVE

SEQ ID NO: 517 - DNA, 1077 bp, Artificial Sequence
  Engineered variant of opine dehydrogenase CENDH
atgatcgagtcaaaaacatacgccgttttgggattaggaaacgggggtcacgcatttgccgcctatttagcattgaagggccagcgtgtactggcttgggacatcgatgctcagagaatcaaagagattcaggaccgtggagccatcatagcggaaggaccaggacttgctgggactgctcacccggatcttctgacctcagatataggtttggcggttaaagacgctgatgtgatactgattgtagtgccggccatccaccacgcttccattgcagcaaatatcgccagttacatttccgagggtcagttgattatccttaaccctggggcaacgggtggagcgctggaattccggaaaatcctgcgtgaaaatggtgcgccggaggtaacgatcggggaaacctcaagtatgctctttacatgccgctccgagagaccaggacaggttacggtaaatgcgataacacgtgccatggactttgcatgtctcccagcggcaaaagctggatgggccctggaacagatagggtcggttcttcctcaataccaggctgtcgaaaacgtgttgcatacttcgctgactaatatcgaagctgtattgcacccgctgccaacactgttaaacgctgctcgttgtgagtctggtaccccattccattattataccgaggggttgacgccatcagtcggggcgcttgcggagaaagtggacgctgaacgcatagcaatcgcaaaggctttcgatttaaacgttccgtcggtctgcgaatggcataagattagttacggccagtcaccggccacaatttatgaagcggtgcagggtaatcctgctctgcgcggcattatgggacctaccagccttaacacggtgcacttcttcgaggatgtaagcaccggactggtaccgttatccgaactgggtcgggcagtgaatgtgcctaccccacttatcgatgctgttcttctgttgatcagttcgctgatagacgtggatttcagaaaggaaggtcgtaccttggaaaaattaggtctgagcggacttaccgccgcggaaataagaagtgctgttgag

SEQ ID NO: 518 - protein, 359 aa, Artificial Sequence
  Engineered variant of opine dehydrogenase CENDH
MIESKTYAVLGLGNGGHAFAAYLALKGQRVLAWDIDAQRIKEIQDRGAIIAEGPGLAGTAHPDLLTSDIGLAVKDADVILIVVPAIHHASIAANIASYISEGQLIILNPGATGGALEFRKILRENGAPEVTIGETSSMLFTCRSERPGQVTVNAITRAMDFACLPAAKAGWALEQIGSVLPQYQAVENVLHTSLTNIEAVLHPLPTLLNAARCESGTPFHYYTEGLTPSVGALAEKVDAERIAIAKAFDLNVPSVCEWHKISYGQSPATIYEAVQGNPALRGIMGPTSLNTVHFFEDVSTGLVPLSELGRAVNVPTPLIDAVLLLISSLIDVDFRKEGRTLEKLGLSGLTAAEIRSAVE

SEQ ID NO: 519 - DNA, 1077 bp, Artificial Sequence
  Engineered variant of opine dehydrogenase CENDH
atgatcgagtcaaaaacatacgccgttttgggattaggaaacgggggtcacgcatttgccgcctatttagcattgaagggccagcgtgtactggcttgggacatcgatgctcagagaatcaaagagattcaggaccgtggagccatcatagcggaaggaccaggacttgctgggactgctcacccggatcttctgacctcagatataggtttggcggttaaagacgctgatgtgatactgattgtagtgccggccatccaccacgcttccattgcagcaaatatcgccagttacatttccgagggtcagttgattatccttaaccctggggcaacgggtggagcgctggaattccggaaaatcctgcgtgaaaatggtgcgccggaggtaacgatcggggaaacctcaagtatgctctttacatgccgctccgagagaccaggacaggttacggtaaatgcgatgacacgtgccatggactttgcatgtctcccagcggcaaaagctggatgggccctggaacagatacattcggttcttcctcaataccaggctgtcgaaaacgtgttgcatacttcgctgactaatatcgaagctgtattgcacccgctgccaacactgttaaacgctgctcgttgtgagtctggtaccccattccattattataccgaggggattacgccatcagtcggggcgcttgcggagaaagtggacgctgaacgcatagcaatcgcaaaggctttcgatttaaacgttccgtcggtctgcgaatggcataagattagttacggccagtcaccggccacaatttatgaagcggtgcagggtaatcctgctctgcgcggcattatgggacctaccagccttaacacggtgcacttcttcgaggatgtaagcaccggactggtaccgttatccgaactgggtcgggtggtgaatgtgcctaccccacttatcgatgctgttatgctgttgatcagtgaactgatagacgtggatttcagaaaggaaggtcgtaccttggaaaaattaggtctgagcggacttaccgccgcggaaataagaagtgctgttgag

SEQ ID NO: 520 - protein, 359 aa, Artificial Sequence
  Engineered variant of opine dehydrogenase CENDH
MIESKTYAVLGLGNGGHAFAAYLALKGQRVLAWDIDAQRIKEIQDRGAIIAEGPGLAGTAHPDLLTSDIGLAVKDADVILIVVPAIHHASIAANIASYISEGQLIILNPGATGGALEFRKILRENGAPEVTIGETSSMLFTCRSERPGQVTVNAMTRAMDFACLPAAKAGWALEQIHSVLPQYQAVENVLHTSLTNIEAVLHPLPTLLNAARCESGTPFHYYTEGITPSVGALAEKVDAERIAIAKAFDLNVPSVCEWHKISYGQSPATIYEAVQGNPALRGIMGPTSLNTVHFFEDVSTGLVPLSELGRVVNVPTPLIDAVMLLISELIDVDFRKEGRTLEKLGLSGLTAAEIRSAVE

SEQ ID NO: 521 - DNA, 1077 bp, Artificial Sequence
  Engineered variant of opine dehydrogenase CENDH
atgatcgagtcaaaaacatacgccgttttgggattaggaaacgggggtcacgcatttgccgcctatttagcattgaagggccagaccgtactggcttgggacatcgatcatcagagaatcaaagagattcaggaccgtggagccatcatagcggaaggaccaggacttgctgggactgctcacccggatcttctgacctcagatataggtttggcggttaaagacgctgatgtgatactgattgtagtgccggccatccaccacgcttccattgcagcaaatatcgccagttacatttccgagggtcagttgattatccttaaccctggggcaacgggtggagcgctggaattccggaaaatcctgcgtgaaaatggtgcgccggaggtaacgatcggggaaacctcaagtatgctctttacatgccgctccgagagaccaggacaggttacggtaaatcagataacacgtgccatggactttgcatgtctcccagcggcaaaagctggatgggccctggaacagatagggtcggttcttcctcaataccaggctgtcgaaaacgtgttgcatacttcgctgactaatatcgaagctgtattgcacccgctgccaacactgttaaacgctgctcgttgtgagtctggtaccccattccattattataccgaggggattacgccatcagtcggggcgcttgcggagaaagtggacgctgaacgcatagcaatcgcaaaggctttcgatttaaacgttccgtcggtctgcgaatggcataagattagttacggccagtcaccggccacaatttatgaagcggtgcagggtaatcctgctctgcgcggcattatgggacctaccagccttaacacggtgcacttcttcgaggatgtaagcaccggactggtaccgttatccgaactgggtcggtgcgtgaatgtgcctaccccacttatcgatgctgttcttctgttgatcagtgaactgatagacgtggatttcagaaaggaaggtcgtaccttggaaaaattaggtctgagcggacttaccgccgcggaaataagaagtgctgttgag

SEQ ID NO: 522 - protein, 359 aa, Artificial Sequence
  Engineered variant of opine dehydrogenase CENDH
MIESKTYAVLGLGNGGHAFAAYLALKGQTVLAWDIDHQRIKEIQDRGAIIAEGPGLAGTAHPDLLTSDIGLAVKDADVILIVVPAIHHASIAANIASYISEGQLIILNPGATGGALEFRKILRENGAPEVTIGETSSMLFTCRSERPGQVTVNQITRAMDFACLPAAKAGWALEQIGSVLPQYQAVENVLHTSLTNIEAVLHPLPTLLNAARCESGTPFHYYTEGITPSVGALAEKVDAERIAIAKAFDLNVPSVCEWHKISYGQSPATIYEAVQGNPALRGIMGPTSLNTVHFFEDVSTGLVPLSELGRCVNVPTPLIDAVLLLISELIDVDFRKEGRTLEKLGLSGLTAAEIRSAVE

SEQ ID NO: 523 - DNA, 1077 bp, Artificial Sequence
  Engineered variant of opine dehydrogenase CENDH
atgatcgagtcaaaaacatacgccgttttgggattaggaaacgggggtcacgcatttgccgcctatttagcattgaagggccagcgtgtactggcttgggacatcgatgctcagagaatcaaagagattcaggaccgtggagccatcatagcggaaggaccaggacttgctgggactgctcacccggatcttctgacctcagatataggtttggcggttaaagacgctgatgtgatactgattgtagtgccggccatccaccacgcttccattgcagcaaaaatcgccagttacatttccgagggtcagttgattatccttaaccctggggcaacgggtggagcgctggaattccggaaaatcctgcgtgaaaatggtgcgccggaggtaacgatcggggaaacctcaagtatgctctttacatgccgctccgagagaccaggacaggttacggtaaatgcgataacacgtgccatggactttgcatgtctcccagcggcaaaagctggatgggccctggaacagatagggtcggttcttcctcaatgccaggctgtcgaaaacgtgttgcatacttcgctgactaatatcgaagctgtattgcacccgctgccaacactgttaaacgctgctcgttgtgagtctggtaccccattccattattataccgaggggattacgccatcagtcggggcgcttgcggagaaagtggacgctgaacgcatagcaatcgcaaaggctttcgatttaaacgttccgtcggtctgcgaatggcataagattagttacggccagtcaccggccacaatttatgaagcggtgcagggtaatcctgctctgcgcggcattatgggacctaccagccttaacacggtgcacgtgttcgaggatgtaagcaccggactggtaccgttatccgaactgggtcgggcagtgaatgtgcctaccccacttatcgatgctgttcttctgttgatcagttcgctgatagacgtggatttcagaaaggaaggtcgtaccttggaaaaattaggtctgagcggacttaccgccgcggaaataagaagtgctgttgag

SEQ ID NO: 524 - protein, 359 aa, Artificial Sequence
  Engineered variant of opine dehydrogenase CENDH
MIESKTYAVLGLGNGGHAFAAYLALKGQRVLAWDIDAQRIKEIQDRGAIIAEGPGLAGTAHPDLLTSDIGLAVKDADVILIVVPAIHHASIAAKIASYISEGQLIILNPGATGGALEFRKILRENGAPEVTIGETSSMLFTCRSERPGQVTVNAITRAMDFACLPAAKAGWALEQIGSVLPQCQAVENVLHTSLTNIEAVLHPLPTLLNAARCESGTPFHYYTEGITPSVGALAEKVDAERIAIAKAFDLNVPSVCEWHKISYGQSPATIYEAVQGNPALRGIMGPTSLNTVHVFEDVSTGLVPLSELGRAVNVPTPLIDAVLLLISSLIDVDFRKEGRTLEKLGLSGLTAAEIRSAVE

SEQ ID NO: 525 - DNA, 1077 bp, Artificial Sequence
  Engineered variant of opine dehydrogenase CENDH
atgatcgagtcaaaaacatacgccgttttgggattaggaaacgggggtcacgcatttgccgcctatttagcattgaagggccagcgtgtactggcttgggacatcgatgctcagagaatcaaagagattcaggaccgtggagccatcatagcggaaggaccaggacttgctgggactgctcacccggatcttctgacctcagatataggtttggcggttaaagacgctgatgtgatactgattgtagtgccggccatccaccacgcttccattgcagcaaaaatcgccagttacatttccgagggtcagttgattatccttaaccctggggcaacgggtggagcgctggaattccggaaaatcctgcgtgaaaatggtgcgccggaggtaacgatcggggaaacctcaagtatgctctttacatgccgctccgagagaccaggacaggttacggtaaattttataacaatggccatggactttgcatgtctcccagcggcaaaagctggatgggccctggaacagatagggtcggttcttcctcaatgccaggctgtcgaaaacgtgttgcatacttcgctgactaatatcgaagctgtattgcacccgctgccaacactgttaaacgctgctcgttgtgagtctggtaccccattccattattataccgaggggattacgccatcagtcggggcgcttgcggagaaagtggacgctgaacgcatagcaatcgcaaaggctttcgatttaaacgttccgtcggtctgcgaatggcataagattagttacggccagtcaccggccacaatttatgaagcggtgcagggtaatcctgctctgcgcggcattatgggacctaccagccttaacacggtgcacttcttcgaggatgtaagcaccggactggtaccgttatccgaactgggtcgggcagtgaatgtgcctaccccacttatcgatgctgttcttctgttgatcagttcgctgatagacgtggatttcagaaaggaaggtcgtaccttggaaaaattaggtctgagcggacttaccgccgcggaaataagaagtgctgttgag

SEQ ID NO: 526 - protein, 359 aa, Artificial Sequence
  Engineered variant of opine dehydrogenase CENDH
MIESKTYAVLGLGNGGHAFAAYLALKGQRVLAWDIDAQRIKEIQDRGAIIAEGPGLAGTAHPDLLTSDIGLAVKDADVILIVVPAIHHASIAAKIASYISEGQLIILNPGATGGALEFRKILRENGAPEVTIGETSSMLFTCRSERPGQVTVNFITMAMDFACLPAAKAGWALEQIGSVLPQCQAVENVLHTSLTNIEAVLHPLPTLLNAARCESGTPFHYYTEGITPSVGALAEKVDAERIAIAKAFDLNVPSVCEWHKISYGQSPATIYEAVQGNPALRGIMGPTSLNTVHFFEDVSTGLVPLSELGRAVNVPTPLIDAVLLLISSLIDVDFRKEGRTLEKLGLSGLTAAEIRSAVE

SEQ ID NO: 527 - DNA, 1077 bp, Artificial Sequence
  Engineered variant of opine dehydrogenase CENDH
atgatcgagtcaaaaacatacgccgttttgggattaggaaacgggggtcacgcatttgccgcctatttagcattgaagggccagcgtgtactggcttgggacatcgatgctcagagaatcaaagagattcaggaccgtggagccatcatagcggaaggaccaggacttgctgggactgctcacccggatcttctgacctcagatataggtttggcggttaaagacgctgatgtgatactgattgtagtgccggccatccaccacgcttccattgcagcacgtatcgccagttacatttccgagggtcagttgattatccttaaccctggggcaacgggtggagcgctggaattccggaaaatcctgcgtgaaaatggtgcgccggaggtaacgatcggggaaacctcaagtatgctctttacatgccgctccgagagaccaggacaggttacggtaaatgcgataacactggccatggactttgcatgtctcccagcggcaaaagctggatgggccctggaacagatagggtcggttcttcctcaataccaggctgtcgaaaacgtgttgcatacttcgctgactaatatcgaagctgtattgcacccgctgccaacactgttaaacgctgctcgttgtgagtctggtaccccattccattattataccgaggggattacgccatcagtcggggcgcttgcggagaaagtggacgctgaacgcatagcaatcgcaaaggctttcgatttaaacgttccgtcggtctgcgaatggcataagattagttacggcctgtcaccggccacaatttatgaagcggtgcagggtaatcctgctctgcgcggcattatgggacctaccagccttaacacggtgcacttcttcgaggatgtaagcaccggactggtaccgttatccgaactgggtcgggcagtgaatgtgcctaccccacttatcgatgctgttgtgctgttgatcagttcgctgatagacgtggatttcagaaaggaaggtcgtaccttggaaaaattaggtctgagcggacttaccgccgcggaaataagaagtgctgttgag

SEQ ID NO: 528 - protein, 359 aa, Artificial Sequence
  Engineered variant of opine dehydrogenase CENDH
MIESKTYAVLGLGNGGHAFAAYLALKGQRVLAWDIDAQRIKEIQDRGAIIAEGPGLAGTAHPDLLTSDIGLAVKDADVILIVVPAIHHASIAARIASYISEGQLIILNPGATGGALEFRKILRENGAPEVTIGETSSMLFTCRSERPGQVTVNAITLAMDFACLPAAKAGWALEQIGSVLPQYQAVENVLHTSLTNIEAVLHPLPTLLNAARCESGTPFHYYTEGITPSVGALAEKVDAERIAIAKAFDLNVPSVCEWHKISYGLSPATIYEAVQGNPALRGIMGPTSLNTVHFFEDVSTGLVPLSELGRAVNVPTPLIDAVVLLISSLIDVDFRKEGRTLEKLGLSGLTAAEIRSAVE

SEQ ID NO: 529 - DNA, 1077 bp, Artificial Sequence
  Engineered variant of opine dehydrogenase CENDH
atgatcgagtcaaaaacatacgccgttttgggattaggaaacgggggtcacgcatttgccgcctatttagcattgaagggccagcgtgtactggcttgggacatcgatgctcagagaatcaaagagattcaggaccgtggagccatcatagcggaaggaccaggacttgctgggactgctcacccggatcttctgacctcagatataggtttggcggttaaagacgctgatgtgatactgattgtagtgccggccatccaccacgcttccattgcagcacgtatcgccagttacatttccgagggtcagttgattatccttaaccctggggcaacgggtggagcgctggaattccggaaaatcctgcgtgaaaatggtgcgccggaggtaacgatcggggaaacctcaagtatgctctttacatgccgctccgagagaccaggacaggttacggtaaatgcgataacactggccatggactttgcatgtctcccagcggcaaaagctggatgggccctggaacagatagggtcggttcttcctcaataccaggctgtcgaaaacgtgttgcatacttcgctgactaatatcgaagctgtattgcacccgctgccaacactgttaaacgctgctcgttgtgagtctggtaccccattccattattataccgaggggattacgccatcagtcggggcgcttgcggagaaagtggacgctgaacgcatagcaatcgcaaaggctttcgatttaaacgttccgtcggtctgcgaatggcataagattagttacggcctgtcaccggccacaatttatgaagcggtgcagggtaatcctgctctgcgcggcattatgggacctaccagccttaacacggtgcacttcttcgaggatgtaagcaccggactggtaccgttatccgaatttggtcgggcagtgaatgtgcctaccccacttatcgatgctgttcttctgttgatcagttcgctgatagacgtggatttcagaaaggaaggtcgtaccttggaaaaattaggtctgagcggacttaccgccgcggaaataagaagtgctgttgag

SEQ ID NO: 530 - protein, 359 aa, Artificial Sequence
  Engineered variant of opine dehydrogenase CENDH
MIESKTYAVLGLGNGGHAFAAYLALKGQRVLAWDIDAQRIKEIQDRGAIIAEGPGLAGTAHPDLLTSDIGLAVKDADVILIVVPAIHHASIAARIASYISEGQLIILNPGATGGALEFRKILRENGAPEVTIGETSSMLFTCRSERPGQVTVNAITLAMDFACLPAAKAGWALEQIGSVLPQYQAVENVLHTSLTNIEAVLHPLPTLLNAARCESGTPFHYYTEGITPSVGALAEKVDAERIAIAKAFDLNVPSVCEWHKISYGLSPATIYEAVQGNPALRGIMGPTSLNTVHFFEDVSTGLVPLSEFGRAVNVPTPLIDAVLLLISSLIDVDFRKEGRTLEKLGLSGLTAAEIRSAVE

SEQ ID NO: 531 - DNA, 1077 bp, Artificial Sequence
  Engineered variant of opine dehydrogenase CENDH
atgatcgagtcaaaaacatacgccgttttgggattaggaaacgggggtcacgcatttgccgcctatttagcattgaagggccagcgtgtactggcttgggacatcgatgctcagagaatcaaagagattcaggaccgtggagccatcatagcggaaggaccaggacttgctgggactgctcacccggatcttctgacctcagatataggtttggcggttaaagacgctgatgtgatactgattgtagtgccggccatccaccacgcttccattgcagcaaatatcgccagttacatttccgagggtcagttgattatccttaaccctggggcaacgggtggagcgctggaattccggaaaatcctgcgtgaaaatggtgcgccggaggtaacgatcggggaaacctcaagtatgctctttacatgccgctccgagagaccaggacaggttacggtaaatatgataacacgtgccatggactttgcatgtctcccagcggcaaaagctggatgggccctggaacagatacattcggttcttcctcaataccaggctgtcgaaaacgtgttgcatacttcgctgactaatatcgaagctgtattgcacccgctgccaacactgttaaacgctgctcgttgtgagtctggtaccccattccattattataccgaggggattacgccatcagtcgggcgtcttgcggagaaagtggacgctgaacgcatagcaatcgcaaaggctttcgatttaaacgttccgtcggtctgcgaatggcataagattagttacggccagtcaccggccacaatttatgaagcggtgcagggtaatcctgctctgcgcggcattatgggacctaccagccttaacacggtgcacttcttcgaggatgtaagcaccggactggtaccgttatccgaactgggtcggtgcgtgaatgtgcctaccccacttatcgatgctgttcttctgttgatcagtgaactgatagacgtggatttcagaaaggaaggtcgtaccttggaaaaattaggtctgagcggacttaccgccgcggaaataagaagtgctgttgag

SEQ ID NO: 532 - protein, 359 aa, Artificial Sequence
  Engineered variant of opine dehydrogenase CENDH
MIESKTYAVLGLGNGGHAFAAYLALKGQRVLAWDIDAQRIKEIQDRGAIIAEGPGLAGTAHPDLLTSDIGLAVKDADVILIVVPAIHHASIAANIASYISEGQLIILNPGATGGALEFRKILRENGAPEVTIGETSSMLFTCRSERPGQVTVNMITRAMDFACLPAAKAGWALEQIHSVLPQYQAVENVLHTSLTNIEAVLHPLPTLLNAARCESGTPFHYYTEGITPSVGRLAEKVDAERIAIAKAFDLNVPSVCEWHKISYGQSPATIYEAVQGNPALRGIMGPTSLNTVHFFEDVSTGLVPLSELGRCVNVPTPLIDAVLLLISELIDVDFRKEGRTLEKLGLSGLTAAEIRSAVE

SEQ ID NO: 533 - DNA, 1077 bp, Artificial Sequence
  Engineered variant of opine dehydrogenase CENDH
atgatcgagtcaaaaacatacgccgttttgggattaggaaacgggggtcacgcatttgccgcctatttagcattgaagggccagcgtgtactggcttgggacatcgatgctcagagaatcaaagagattcaggaccgtggagccatcatagcggaaggaccaggacttgctgggactgctcacccggatcttctgacctcagatataggtttggcggttaaagacgctgatgtgatactgattgtagtgccggccatccaccacgcttccattgcagcaaatatcgccagttacatttccgagggtcagttgattatccttaaccctggggcaacgggtggagcgctggaattccggaaaatcctgcgtgaaaatggtgcgccggaggtaacgatcggggaaacctcaagtatgctctttacatgccgctccgagagaccaggacaggttacggtaaatatgataacacgtgccatggactttgcatgtctcccagcggcaaaagctggatgggccctggaacagatacattcggttcttcctcaataccaggctgtcgaaaacgtgttgcatacttcgctgactaatatcgaagctgtattgcacccgctgccaacactgttaaacgctgctcgttgtgagtctggtaccccattccattattataccgaggggattacgccatcagtcggggcgcttgcggagaaagtggacgctgaacgcatagcaatcgcaaaggctttcgatttaaacgttccgtcggtcgtggaatggcataagattagttacggccagtcaccggccacaatttatgaagcggtgcagggtaatcctgctctgcgcggcattatgggacctaccagccttaacacggtgcacttcttcgaggatgtaagcaccggactggtaccgttatccgaactgggtcgggtggtgaatgtgcctaccccacttatcgatgctgttcttctgttgatcagttcgctgatagacgtggatttcagaaaggaaggtcgtaccttggaaaaattaggtctgagcggacttaccgccgcggaaataagaagtgctgttgag

SEQ ID NO: 534 - protein, 359 aa, Artificial Sequence
  Engineered variant of opine dehydrogenase CENDH
MIESKTYAVLGLGNGGHAFAAYLALKGQRVLAWDIDAQRIKEIQDRGAIIAEGPGLAGTAHPDLLTSDIGLAVKDADVILIVVPAIHHASIAANIASYISEGQLIILNPGATGGALEFRKILRENGAPEVTIGETSSMLFTCRSERPGQVTVNMITRAMDFACLPAAKAGWALEQIHSVLPQYQAVENVLHTSLTNIEAVLHPLPTLLNAARCESGTPFHYYTEGITPSVGALAEKVDAERIAIAKAFDLNVPSVVEWHKISYGQSPATIYEAVQGNPALRGIMGPTSLNTVHFFEDVSTGLVPLSELGRVVNVPTPLIDAVLLLISSLIDVDFRKEGRTLEKLGLSGLTAAEIRSAVE

SEQ ID NO: 535 - DNA, 1077 bp, Artificial Sequence
  Engineered variant of opine dehydrogenase CENDH
atgatcgagtcaaaaacatacgccgttttgggattaggaaacgggggtcacgcatttgccgcctatttagcattgaagggccagcgtgtactggcttgggacatcgatgctcagagaatcaaagagattcaggaccgtggagccatcatagcggaaggaccaggacttgctgggactgctcacccggatcttctgacctcagatataggtttggcggttaaagacgctgatgtgatactgattgtagtgccggccatccaccacgcttccattgcagcaaatatcgccagttacatttccgagggtcagttgattatccttaaccctggggcaacgggtggagcgctggaattccggaaaatcctgcgtgaaaatggtgcgccggaggtaacgatcggggaaacctcaagtatgctctttacatgccgctccgagagaccaggacaggttacggtaaattttataacacgtgccatggactttgcatgtctcccagcggcaaaagctggatgggccctggaacagatagggtcggttcttcctcaataccaggctgtcgaaaacgtgttgcatacttcgctgactaatatcgaagctgtattgcacccgctgccaacactgttaaacgctgctcgttgtgagtctggtaccccattccattattataccgaggggattacgccatcagtcggggcgcttgcggagaaagtggacgctgaacgcatagcaatcgcaaaggctttcgatttaaacgttccgtcggtctgcgaatggcataagattagttacggccagtcaccggccacaatttatgaagcggtgcagggtaatcctgctctgcgcggcattatgggacctaccagccttaacacggtgcacttcttcgaggatgtaagcaccggactggtaccgttatccgaactgggtcgggcagtgaatgtgcctaccccacttatcgatgctgttcttctgttgatcagtgcgctgatagacgtggatttcagaaaggaaggtcgtaccttggaaaaattaggtctgagcggacttaccgccgcggaaataagaagtgctgttgag

SEQ ID NO: 536 - protein, 359 aa, Artificial Sequence
  Engineered variant of opine dehydrogenase CENDH
MIESKTYAVLGLGNGGHAFAAYLALKGQRVLAWDIDAQRIKEIQDRGAIIAEGPGLAGTAHPDLLTSDIGLAVKDADVILIVVPAIHHASIAANIASYISEGQLIILNPGATGGALEFRKILRENGAPEVTIGETSSMLFTCRSERPGQVTVNFITRAMDFACLPAAKAGWALEQIGSVLPQYQAVENVLHTSLTNIEAVLHPLPTLLNAARCESGTPFHYYTEGITPSVGALAEKVDAERIAIAKAFDLNVPSVCEWHKISYGQSPATIYEAVQGNPALRGIMGPTSLNTVHFFEDVSTGLVPLSELGRAVNVPTPLIDAVLLLISALIDVDFRKEGRTLEKLGLSGLTAAEIRSAVE

SEQ ID NO: 537 - DNA, 1077 bp, Artificial Sequence
  Engineered variant of opine dehydrogenase CENDH
atgatcgagtcaaaaacatacgccgttttgggattaggaaacgggggtcacgcatttgccgcctatttagcattgaagggccagcgtgtactggcttgggacatcgatgctcagagaatcaaagagattcaggaccgtggagccatcatagcggaaggaccaggacttgctgggactgctcacccggatcttctgacctcagatataggtttggcggttaaagacgctgatgtgatactgattgtagtgccggccatccaccacgcttccattgcagcaaatatcgccagttacatttccgagggtcagttgattatccttaaccctggggcaacgggtggagcgctggaattccggaaaatcctgcgtgaaaatggtgcgccggaggtaacgatcggggaaacctcaagtatgctctttacatgccgctccgagagaccaggacaggttacggtaaatgcgataacactggccatggactttgcatgtctcccagcggcaaaagctggatgggccctggaacagatagggtcggttcttcctcaataccaggctgtcgaaaacgtgttgcatacttcgctgactaatatcgaagctgtattgcacccgctgccaacactgttaaacgctgctcgttgtgagtctggtaccccattccattattataccgaggggattacgccatcagtcggggcgcttgcggagaaagtggacgctgaacgcatagcaatcgcaaaggctttcgatttaaacgttccgtcggtctgcgaatggcataagattagttacggcctgtcaccggccacaatttatgaagcggtgcagggtaatcctgctctgcgcggcattatgggacctaccagccttaacacggtgcacttcttcgaggatgtaagcaccggactggtaccgttatccgaactgggtcgggcagtgaatgtgcctaccccacttatcgatgctgttcttctgttgatcagttcgctgatagacgtggatttcagaaaggaaggtcgtaccttggaaaaattaggtctgagcggacttaccgccgcggaaataagaagtgctgttgag

SEQ ID NO: 538 - protein, 359 aa, Artificial Sequence
  Engineered variant of opine dehydrogenase CENDH
MIESKTYAVLGLGNGGHAFAAYLALKGQRVLAWDIDAQRIKEIQDRGAIIAEGPGLAGTAHPDLLTSDIGLAVKDADVILIVVPAIHHASIAANIASYISEGQLIILNPGATGGALEFRKILRENGAPEVTIGETSSMLFTCRSERPGQVTVNAITLAMDFACLPAAKAGWALEQIGSVLPQYQAVENVLHTSLTNIEAVLHPLPTLLNAARCESGTPFHYYTEGITPSVGALAEKVDAERIAIAKAFDLNVPSVCEWHKISYGLSPATIYEAVQGNPALRGIMGPTSLNTVHFFEDVSTGLVPLSELGRAVNVPTPLIDAVLLLISSLIDVDFRKEGRTLEKLGLSGLTAAEIRSAVE

SEQ ID NO: 539 - DNA, 1077 bp, Artificial Sequence
  Engineered variant of opine dehydrogenase CENDH
atgatcgagtcaaaaacatacgccgttttgggattaggaaacgggggtcacgcatttgccgcctatttagcattgaagggccagcgtgtactggcttgggacatcgatgctcagagaatcaaagagattcaggaccgtggagccatcatagcggaaggaccaggacttgctgggactgctcacccggatcttctgacctcagatataggtttggcggttaaagacgctgatgtgatactgattgtagtgccggccatccaccacgcttccattgcagcaaatatcgccagttacatttccgagggtcagttgattatccttaaccctggggcaacgggtggagcgctggaattccggaaaatcctgcgtgaaaatggtgcgccggaggtaacgatcggggaaacctcaagtatgctctttacatgccgctccgagagaccaggacaggttacggtaaatgcgataacacgtgccatggactttgcatgtctcccagcggcaaaagctggatgggccctggaacagatagggtcggttcttcctcaatgccaggctgtcgaaaacgtgttgcatacttcgctgactaatatcgaagctgtattgcacccgctgccaacactgttaaacgctgctcgttgtgagtctggtaccccattccattattataccgaggggattacgccatcagtcggggcgcttgcggagaaagtggacgctgaacgcatagcaatcgcaaaggctttcgatttaaacgttccgtcggtctgcgaatggcataagattagttacggccagtcaccggccacaatttatgaagcggtgcagggtaatcctgctctgcgcggcattatgggacctaccagccttaacacggtgcacttcttcgaggatgtaagcaccggactggtaccgttatccgaactgggtcgggcagtgaatgtgcctaccccacttatcgatgctgttgtgctgttgatcagttcgctgatagacgtggatttcagaaaggaaggtcgtaccttggaaaaattaggtctgagcggacttaccgccgcggaaataagaagtgctgttgag

SEQ ID NO: 540 - protein, 359 aa, Artificial Sequence
  Engineered variant of opine dehydrogenase CENDH
MIESKTYAVLGLGNGGHAFAAYLALKGQRVLAWDIDAQRIKEIQDRGAIIAEGPGLAGTAHPDLLTSDIGLAVKDADVILIVVPAIHHASIAANIASYISEGQLIILNPGATGGALEFRKILRENGAPEVTIGETSSMLFTCRSERPGQVTVNAITRAMDFACLPAAKAGWALEQIGSVLPQCQAVENVLHTSLTNIEAVLHPLPTLLNAARCESGTPFHYYTEGITPSVGALAEKVDAERIAIAKAFDLNVPSVCEWHKISYGQSPATIYEAVQGNPALRGIMGPTSLNTVHFFEDVSTGLVPLSELGRAVNVPTPLIDAVVLLISSLIDVDFRKEGRTLEKLGLSGLTAAEIRSAVE

SEQ ID NO: 541 - DNA, 1077 bp, Artificial Sequence
  Engineered variant of opine dehydrogenase CENDH
atgatcgagcgtaaaacatacgccgttttgggattaggaaacgggggtcacgcatttgccgcctatttagcattgaagggccagcgtgtactggcttgggacatcgatgctcagagaatcaaagagattcaggaccgtggagccatcatagcggaaggaccaggacttgctgggactgctcacccggatcttctgacctcagatataggtttggcggttcgtgacgctgatgtgatactgattgtagtgccggccatccaccacgcttccattgcagcaaatatcgccagttacatttccgagggtcagttgattatccttaaccctggggcaacgggtggagcgctggaattccggaaaatcctgcgtgaaaatggtgcgccggaggtaacgatcggggaaacctcaagtatgctctttacatgccgctccgagagaccaggacaggttacggtaaatgcgataacacgtgccatggactttgcaaccctcccagcggcaaaagctggatgggccctggaacagatagggtcggttcttcctcaataccaggctgtcgaaaacgtgttgcatacttcgctgactaatatcgaagctgtattgcacccgctgccaacactgttaaacgctgctcgttgtgagtctggtaccccattccattattataccgaggggattacgccatcagtcggggcgcttgcggagaaagtggacgctgaacgcatagcaatcgcaaaggctttcgatttaaacgttccgtcggtctgcgaatggcataagattagttacggccagtcaccggccacaatttatgaagcggtgcagggtaatcctgctctgcgcggcattatgggacctaccagccttaacacggtgcacttcttcgaggatgtaagcaccggactggtaccgttatccgaactgggtcgggcagtgaatgtgcctaccccacttatcgatgctgttcttctgttgatcagttcgctgatagacgtggatttcagaaaggaaggtcgtaccttggaaaaattaggtctgagcggacttaccgccgcggaaataagaagtgctgttgag

SEQ ID NO: 542 - protein, 359 aa, Artificial Sequence
  Engineered variant of opine dehydrogenase CENDH
MIERKTYAVLGLGNGGHAFAAYLALKGQRVLAWDIDAQRIKEIQDRGAIIAEGPGLAGTAHPDLLTSDIGLAVRDADVILIVVPAIHHASIAANIASYISEGQLIILNPGATGGALEFRKILRENGAPEVTIGETSSMLFTCRSERPGQVTVNAITRAMDFATLPAAKAGWALEQIGSVLPQYQAVENVLHTSLTNIEAVLHPLPTLLNAARCESGTPFHYYTEGITPSVGALAEKVDAERIAIAKAFDLNVPSVCEWHKISYGQSPATIYEAVQGNPALRGIMGPTSLNTVHFFEDVSTGLVPLSELGRAVNVPTPLIDAVLLLISSLIDVDFRKEGRTLEKLGLSGLTAAEIRSAVE

SEQ ID NO: 543 - DNA, 1077 bp, Artificial Sequence
  Engineered variant of opine dehydrogenase CENDH
atgatcgagtcaaaaacatacgccgttttgggattaggaaacgggggtcacgcatttgccgcctatttagcattgaagggccagcgtgtactggcttgggacatcgatgctcagagaatcaaagagattcaggaccgtggagccatcatagcggaaggaccaggacttgctgggactgctcacccggatcttctgacctcagatataggtttggcggttaaagacgctgatgtgatactgattgtagtgccggccatccaccacgcttccattgcagcaaatatcgccagttacatttccgagggtcagttgattatccttaaccctggggcaacgggtggagcgctggaattccggaaaatcctgcgtgaaaatggtgcgccggaggtaacgatcggggaaacctcaagtatgctctttacatgccgctccgagagaccaggacaggttacggtaaatatgataacacgtgccatggactttgcatgtctcccagcggcaaaagctggatgggccctggaacagatagggtcggttcttcctcaataccaggctgtcgaaaacgtgttgcatacttcgctgactaatatcgaagctgtattgcacccgctgccaacactgttaaacgctgctcgttgtgagtctggtaccccattccattattataccgaggggattacgccatcagtcggggcgcttgcggagaaagtggacgctgaacgcatagcaatcgcaaaggctttcgatttaaacgttccgtcggtctgcgaatggcataagattagttacggccagtcaccggccacaatttatgaagcggtgcagggtaatcctgctctgcgcggcattatgggacctaccagccttaacacggtgcacttcttcgaggatgtaagcaccggactggtaccgttatccgaactgggtcgggcagtgaatgtgcctaccccacttatcgatgctgttcttctgttgatcagtgaactgatagacgtggatttcagaaaggaaggtcgtaccttggaaaaattaggtctgagcggacttaccgccgcggaaataagaagtgctgttgag

SEQ ID NO: 544 - protein, 359 aa, Artificial Sequence
  Engineered variant of opine dehydrogenase CENDH
MIESKTYAVLGLGNGGHAFAAYLALKGQRVLAWDIDAQRIKEIQDRGAIIAEGPGLAGTAHPDLLTSDIGLAVKDADVILIVVPAIHHASIAANIASYISEGQLIILNPGATGGALEFRKILRENGAPEVTIGETSSMLFTCRSERPGQVTVNMITRAMDFACLPAAKAGWALEQIGSVLPQYQAVENVLHTSLTNIEAVLHPLPTLLNAARCESGTPFHYYTEGITPSVGALAEKVDAERIAIAKAFDLNVPSVCEWHKISYGQSPATIYEAVQGNPALRGIMGPTSLNTVHFFEDVSTGLVPLSELGRAVNVPTPLIDAVLLLISELIDVDFRKEGRTLEKLGLSGLTAAEIRSAVE

SEQ ID NO: 545 - DNA, 1077 bp, Artificial Sequence
  Engineered variant of opine dehydrogenase CENDH
atgatcgagtcaaaaacatacgccgttttgggattaggaaacgggggtcacgcatttgccgcctatttagcattgaagggccagcgtgtactggcttgggacatcgatgctcagagaatcaaagagattcaggaccgtggagccatcatagcggaaggaccaggacttgctgggactgctcacccggatcttctgacctcagatataggtttggcggttaaagacgctgatgtgatactgattgtagtgccggccatccaccacgcttccattgcagcaaatatcgccagttacatttccgagggtcagttgattatccttaaccctggggcaacgggtggagcgctggaattccggaaaatcctgcgtgaaaatggtgcgccggaggtaacgatcggggaaacctcaagtatgctctttacatgccgctccgagagaccaggacaggttacggtaaatatgatgacacgtgccatggactttgcatgtctcccagcggcaaaagctggatgggccctggaacagatagggtcggttcttcctcaataccaggctgtcgaaaacgtgttgcatacttcgctgactaatatcgaagctgtattgcacccgctgccaacactgttaaacgctgctcgttgtgagtctggtaccccattccattattataccgaggggattacgccatcagtcggggcgcttgcggagaaagtggacgctgaacgcatagcaatcgcaaaggctttcgatttaaacgttccgtcggtcgtggaatggcataagattagttacggccagtcaccggccacaatttatgaagcggtgcagggtaatcctgctctgcgcggcattatgggacctaccagccttaacacggtgcacttcttcgaggatgtaagcaccggactggtaccgttatccgaactgggtcgggtggtgaatgtgcctaccccacttatcgatgctgttcttctgttgatcagtgaactgatagacgtggatttcagaaaggaaggtcgtaccttggaaaaattaggtctgagcggacttaccgccgcggaaataagaagtgctgttgag

SEQ ID NO: 546 - protein, 359 aa, Artificial Sequence
  Engineered variant of opine dehydrogenase CENDH
MIESKTYAVLGLGNGGHAFAAYLALKGQRVLAWDIDAQRIKEIQDRGAIIAEGPGLAGTAHPDLLTSDIGLAVKDADVILIVVPAIHHASIAANIASYISEGQLIILNPGATGGALEFRKILRENGAPEVTIGETSSMLFTCRSERPGQVTVNMMTRAMDFACLPAAKAGWALEQIGSVLPQYQAVENVLHTSLTNIEAVLHPLPTLLNAARCESGTPFHYYTEGITPSVGALAEKVDAERIAIAKAFDLNVPSVVEWHKISYGQSPATIYEAVQGNPALRGIMGPTSLNTVHFFEDVSTGLVPLSELGRVVNVPTPLIDAVLLLISELIDVDFRKEGRTLEKLGLSGLTAAEIRSAVE

SEQ ID NO: 547 - DNA, 1077 bp, Artificial Sequence
  Engineered variant of opine dehydrogenase CENDH
atgatcgagcataaaacatacgccgttttgggattaggaaacgggggtcacgcatttgccgcctatttagcattgaagggccagcgtgtactggcttgggacatcgatgctcagagaatcaaagagattcaggaccgtggagccatcatagcggaaggaccaggacttgctgggactgctcacccggatcttctgacctcagatataggtttggcggttaaagacgctgatgtgatactgattgtagtgccggccatccaccacgcttccattgcagcacgtatcgccagttacatttccgagggtcagttgattatccttaaccctggggcaacgggtggagcgctggaattccggaaaatcctgcgtgaaaatggtgcgccggaggtaacgatcggggaaacctcaagtatgctctttacatgccgctccgagagaccaggacaggttacggtaaattatataacactggccatggactttgcatgtctcccagcggcaaaagctggatgggccctggaacagatagggtcggttcttcctcaataccaggctgtcgaaaacgtgttgcatacttcgctgactaatatcgaagctgtattgcacccgctgccaacactgttaaacgctgctcgttgtgagtctggtaccccattccattattataccgaggggattacgccatcagtcggggcgcttgcggagaaagtggacgctgaacgcatagcaatcgcaaaggctttcgatttaaacgttccgtcggtctgcgaatggcataagattagttacggccagtcaccggccacaatttatgaagcggtgcagggtaatcctgctctgcgcggcattatgggacctaccagccttaacacggtgcacttcttcgaggatgtaagcaccggactggtaccgttatccgaactgggtcgggcagtgaatgtgcctaccccacttatcgatgctgttaccctgttgatcagttcgctgatagacgtggatttcagaaaggaaggtcgtaccttggaaaaattaggtctgagcggacttaccgccgcggaaataagaagtgctgttgag

SEQ ID NO: 548 - protein, 359 aa, Artificial Sequence
  Engineered variant of opine dehydrogenase CENDH
MIEHKTYAVLGLGNGGHAFAAYLALKGQRVLAWDIDAQRIKEIQDRGAIIAEGPGLAGTAHPDLLTSDIGLAVKDADVILIVVPAIHHASIAARIASYISEGQLIILNPGATGGALEFRKILRENGAPEVTIGETSSMLFTCRSERPGQVTVNYITLAMDFACLPAAKAGWALEQIGSVLPQYQAVENVLHTSLTNIEAVLHPLPTLLNAARCESGTPFHYYTEGITPSVGALAEKVDAERIAIAKAFDLNVPSVCEWHKISYGQSPATIYEAVQGNPALRGIMGPTSLNTVHFFEDVSTGLVPLSELGRAVNVPTPLIDAVTLLISSLIDVDFRKEGRTLEKLGLSGLTAAEIRSAVE

SEQ ID NO: 549 - DNA, 1077 bp, Artificial Sequence
  Engineered variant of opine dehydrogenase CENDH
atgatcgagtcaaaaacatacgccgttttgggattaggaaacgggggtcacgcatttgccgcctatttagcattgaagggccagcgtgtactggcttgggacatcgatgctcagagaatcaaagagattcaggaccgtggagccatcatagcggaaggaccaggacttgctgggactgctcacccggatcttctgacctcagatataggtttggcggttaaagacgctgatgtgatactgattgtagtgccggccatccaccacgcttccattgcagcaaatatcgccagttacatttccgagggtcagttgattatccttaaccctggggcaacgggtggagcgctggaattccggaaaatcctgcgtgaaaatggtgcgccggaggtaacgatcggggaaacctcaagtatgctctttacatgccgctccgagagaccaggacaggttacggtaaatgcgataacacgtgccatggactttgcatgtctcccagcggcaaaagctggatgggccctggaacagatagggtcggttcttcctcaatgccaggctgtcgaaaacgtgttgcatacttcgctgactaatatcgaagctgtattgcacccgctgccaacactgttaaacgctgctcgttgtgagtctggtaccccattccattattataccgaggggattacgccatcagtcggggcgcttgcggagaaagtggacgctgaacgcatagcaatcgcaaaggctttcgatttaaacgttccgtcggtctgcgaatggcataagattagttacggcctgtcaccggccacaatttatgaagcggtgcagggtaatcctgctctgcgcggcattatgggacctaccagccttaacacggtgcacgtgttcgaggatgtaagcaccggactggtaccgttatccgaactgggtcgggcagtgaatgtgcctaccccacttatcgatgctgttcttctgttgatcagttcgctgatagacgtggatttcagaaaggaaggtcgtaccttggaaaaattaggtctgagcggacttaccgccgcggaaataagaagtgctgttgag

SEQ ID NO: 550 - protein, 359 aa, Artificial Sequence
  Engineered variant of opine dehydrogenase CENDH
MIESKTYAVLGLGNGGHAFAAYLALKGQRVLAWDIDAQRIKEIQDRGAIIAEGPGLAGTAHPDLLTSDIGLAVKDADVILIVVPAIHHASIAANIASYISEGQLIILNPGATGGALEFRKILRENGAPEVTIGETSSMLFTCRSERPGQVTVNAITRAMDFACLPAAKAGWALEQIGSVLPQCQAVENVLHTSLTNIEAVLHPLPTLLNAARCESGTPFHYYTEGITPSVGALAEKVDAERIAIAKAFDLNVPSVCEWHKISYGLSPATIYEAVQGNPALRGIMGPTSLNTVHVFEDVSTGLVPLSELGRAVNVPTPLIDAVLLLISSLIDVDFRKEGRTLEKLGLSGLTAAEIRSAVE

SEQ ID NO: 551 - DNA, 1077 bp, Artificial Sequence
  Engineered variant of opine dehydrogenase CENDH
atgatcgagtcaaaaacatacgccgttttgggattaggaaacgggggtcacgcatttgccgcctatttagcattgaagggccagcgtgtactggcttgggacatcgatgctcagagaatcaaagagattcaggaccgtggagccatcatagcggaaggaccaggacttgctgggactgctcacccggatcttctgacctcagatataggtttggcggttaaagacgctgatgtgatactgattgtagtgccggccatccaccacgcttccattgcagcaaatatcgccagttacatttccgagggtcagttgattatccttaaccctggggcaacgggtggagcgctggaattccggaaaatcctgcgtgaaaatggtgcgccggaggtaacgatcggggaaacctcaagtatgctctttacatgccgctccgagagaccaggacaggttacggtaaattttataacacgtgccatggactttgcatgtctcccagcggcaaaagctggatgggccctggaacagatagggtcggttcttcctcaataccaggctgtcgaaaacgtgttgcatacttcgctgactaatatcgaagctgtattgcacccgctgccaacactgttaaacgctgctcgttgtgagtctggtaccccattccattattataccgaggggattacgccatcagtcggggcgcttgcggagaaagtggacgctgaacgcatagcaatcgcaaaggctttcgatttaaacgttccgtcggtctgcgaatggcataagattagttacggccagtcaccggccacaatttatgaagcggtgcagggtaatcctgctctgcgcggcattatgggacctaccagccttaacacggtgcacttcttcgaggatgtaagcaccggactggtaccgttatccgaactgggtcggtgcgtgaatgtgcctaccccacttatcgatgctgttctgctgttgatcagttcgctgatagacgtggatttcagaaaggaaggtcgtaccttggaaaaattaggtctgagcggacttaccgccgcggaaataagaagtgctgttgag

SEQ ID NO: 552 - protein, 359 aa, Artificial Sequence
  Engineered variant of opine dehydrogenase CENDH
MIESKTYAVLGLGNGGHAFAAYLALKGQRVLAWDIDAQRIKEIQDRGAIIAEGPGLAGTAHPDLLTSDIGLAVKDADVILIVVPAIHHASIAANIASYISEGQLIILNPGATGGALEFRKILRENGAPEVTIGETSSMLFTCRSERPGQVTVNFITRAMDFACLPAAKAGWALEQIGSVLPQYQAVENVLHTSLTNIEAVLHPLPTLLNAARCESGTPFHYYTEGITPSVGALAEKVDAERIAIAKAFDLNVPSVCEWHKISYGQSPATIYEAVQGNPALRGIMGPTSLNTVHFFEDVSTGLVPLSELGRCVNVPTPLIDAVLLLISSLIDVDFRKEGRTLEKLGLSGLTAAEIRSAVE

SEQ ID NO: 553 - DNA, 1077 bp, Artificial Sequence
  Engineered variant of opine dehydrogenase CENDH
atgatcgagtcaaaaacatacgccgttttgggattaggaaacgggggtcacgcatttgccgcctatttagcattgaagggccagcgtgtactggcttgggacatcgatcatcagagaatcaaagagattcaggaccgtggagccatcatagcggaaggaccaggacttgctgggactgctcacccggatcttctgacctcagatataggtttggcggttaaagacgctgatgtgatactgattgtagtgccggccatccaccacgcttccattgcagcaaatatcgccagttacatttccgagggtcagttgattatccttaaccctggggcaacgggtggagcgctggaattccggaaaatcctgcgtctgaatggtgcgccggaggtaacgatcggggaaacctcaagtatgctctttacatgccgctccgagagaccaggacaggttacggtaaattttataacacgtgccatggactttgcatgtctcccagcggcaaaagctggatgggccctggaacagatacattcggttcttcctcaataccaggctgtcgaaaacgtgttgcatacttcgctgactaatatcgaagctgtattgcacccgctgccaacactgttaaacgctgctcgttgtgagtctggtaccccattccattattataccgaggggattacgccatcagtcggggcgcttgcggagaaagtggacgctgaacgcatagcaatcgcaaaggctttcgatttaaacgttccgtcggtctgcgaatggcataagattagttacggccagtcaccggccacaatttatgaagcggtgcagggtaatcctgctctgcgcggcattatgggacctaccagccttaacacggtgcacttcttcgaggatgtaagcaccggactggtaccgttatccgaactgggtcggtgcgtgaatgtgcctaccccacttatcgatgctgttatgctgttgatcagtgaactgatagacgtggatttcagaaaggaaggtcgtaccttggaaaaattaggtctgagcggacttaccgccgcggaaataagaagtgctgttgag

SEQ ID NO: 554 - protein, 359 aa, Artificial Sequence
  Engineered variant of opine dehydrogenase CENDH
MIESKTYAVLGLGNGGHAFAAYLALKGQRVLAWDIDHQRIKEIQDRGAIIAEGPGLAGTAHPDLLTSDIGLAVKDADVILIVVPAIHHASIAANIASYISEGQLIILNPGATGGALEFRKILRLNGAPEVTIGETSSMLFTCRSERPGQVTVNFITRAMDFACLPAAKAGWALEQIHSVLPQYQAVENVLHTSLTNIEAVLHPLPTLLNAARCESGTPFHYYTEGITPSVGALAEKVDAERIAIAKAFDLNVPSVCEWHKISYGQSPATIYEAVQGNPALRGIMGPTSLNTVHFFEDVSTGLVPLSELGRCVNVPTPLIDAVMLLISELIDVDFRKEGRTLEKLGLSGLTAAEIRSAVE

SEQ ID NO: 555 - DNA, 1077 bp, Artificial Sequence
  Engineered variant of opine dehydrogenase CENDH
atgatcgagtcaaaaacatacgccgttttgggattaggaaacgggggtcacgcatttgccgcctatttagcattgaagggccagcgtgtactggcttgggacatcgatgctcagagaatcaaagagattcaggaccgtggagccatcatagcggaaggaccaggacttgctgggactgctcacccggatcttctgacctcagatataggtttggcggttaaagacgctgatgtgatactgattgtagtgccggccatccaccacgcttccattgcagcaaatatcgccagttacatttccgagggtcagttgattatccttaaccctggggcaacgggtggagcgctggaattccggaaaatcctgcgtgaaaatggtgcgccggaggtaacgatcggggaaacctcaagtatgctctttacatgccgctccgagagaccaggacaggttacggtaaattatataacacgtgccatggactttgcatgtctcccagcggcaaaagctggatgggccctggaacagatagggtcggttcttcctcaatgccaggctgtcgaaaacgtgttgcatacttcgctgactaatatcgaagctgtattgcacccgctgccaacactgttaaacgctgctcgttgtgagtctggtaccccattccattattataccgaggggattacgccatcagtcggggcgcttgcggagaaagtggacgctgaacgcatagcaatcgcaaaggctttcgatttaaacgttccgtcggtctgcgaatggcataagattagttacggcctgtcaccggccacaatttatgaagcggtgcagggtaatcctgctctgcgcggcattatgggacctaccagccttaacacggtgcacttcttcgaggatgtaagcaccggactggtaccgttatccgaactgggtcgggcagtgaatgtgcctaccccacttatcgatgctgttcttctgttgatcagttcgctgatagacgtggatttcagaaaggaaggtcgtaccttggaaaaattaggtctgagcggacttaccgccgcggaaataagaagtgctgttgag

SEQ ID NO: 556 - protein, 359 aa, Artificial Sequence
  Engineered variant of opine dehydrogenase CENDH
MIESKTYAVLGLGNGGHAFAAYLALKGQRVLAWDIDAQRIKEIQDRGAIIAEGPGLAGTAHPDLLTSDIGLAVKDADVILIVVPAIHHASIAANIASYISEGQLIILNPGATGGALEFRKILRENGAPEVTIGETSSMLFTCRSERPGQVTVNYITRAMDFACLPAAKAGWALEQIGSVLPQCQAVENVLHTSLTNIEAVLHPLPTLLNAARCESGTPFHYYTEGITPSVGALAEKVDAERIAIAKAFDLNVPSVCEWHKISYGLSPATIYEAVQGNPALRGIMGPTSLNTVHFFEDVSTGLVPLSELGRAVNVPTPLIDAVLLLISSLIDVDFRKEGRTLEKLGLSGLTAAEIRSAVE

SEQ ID NO: 557 - DNA, 1077 bp, Artificial Sequence
  Engineered variant of opine dehydrogenase CENDH
atgatcgagtcaaaaacatacgccgttttgggattaggaaacgggggtcacgcatttgccgcctatttagcattgaagggccagcgtgtactggcttgggacatcgatgctcagagaatcaaagagattcaggaccgtggagccatcatagcggaaggaccaggacttgctgggactgctcacccggatcttctgacctcagatataggtttggcggttaaagacgctgatgtgatactgattgtagtgccggccatccaccacgcttccattgcagcaaccatcgccagttacatttccgagggtcagttgattatccttaaccctggggcaacgggtggagcgctggaattccggaaaatcctgcgtgaaaatggtgcgccggaggtaacgatcggggaaacctcaagtatgctctttacatgccgctccgagagaccaggacaggttacggtaaatgcgataacacgtgccatggactttgcatgtctcccagcggcaaaagctggatgggccctggaacagatagggtcggttcttcctcaataccaggctgtcgaaaacgtgttgcatacttcgctgactaatatcgaagctgtattgcacccgctgccaacactgttaaacgctgctcgttgtgagtctggtaccccattccattattataccgaggggattacgccatcagtcggggcgcttgcggagaaagtggacgctgaacgcatagcaatcgcaaaggctttcgatttaaacgttccgtcggtctgcgaatggcataagattagttacggcctgtcaccggccacaatttatgaagcggtgcagggtaatcctgctctgcgcggcattatgggacctaccagccttaacacggtgcacttcttcgaggatgtaagcaccggactggtaccgttatccgaactgggtcgggcagtgaatgtgcctaccccacttatcgatgctgttcttctgttgatcagttcgctgatagacgtggatttcagaaaggaaggtcgtaccttggaaaaattaggtctgagcggacttaccgccgcggaaataagaagtgctgttgag

SEQ ID NO: 558 - protein, 359 aa, Artificial Sequence
  Engineered variant of opine dehydrogenase CENDH
MIESKTYAVLGLGNGGHAFAAYLALKGQRVLAWDIDAQRIKEIQDRGAIIAEGPGLAGTAHPDLLTSDIGLAVKDADVILIVVPAIHHASIAATIASYISEGQLIILNPGATGGALEFRKILRENGAPEVTIGETSSMLFTCRSERPGQVTVNAITRAMDFACLPAAKAGWALEQIGSVLPQYQAVENVLHTSLTNIEAVLHPLPTLLNAARCESGTPFHYYTEGITPSVGALAEKVDAERIAIAKAFDLNVPSVCEWHKISYGLSPATIYEAVQGNPALRGIMGPTSLNTVHFFEDVSTGLVPLSELGRAVNVPTPLIDAVLLLISSLIDVDFRKEGRTLEKLGLSGLTAAEIRSAVE

SEQ ID NO: 559 - DNA, 1077 bp, Artificial Sequence
  Engineered variant of opine dehydrogenase CENDH
atgatcgagtcaaaaacatacgccgttttgggattaggaaacgggggtcacgcatttgccgcctatttagcattgaagggccagcgtgtactggcttgggacatcgatgctcagagaatcaaagagattcaggaccgtggagccatcatagcggaaggaccaggacttgctgggactgctcacccggatcttctgacctcagatataggtttggcggttaaagacgctgatgtgatactgattgtagtgccggccatccaccacgcttccattgcagcaaatatcgccagttacatttccgagggtcagttgattatccttaaccctggggcaacgggtggagcgctggaattccggaaaatcctgcgtgaaaatggtgcgccggaggtaacgatcggggaaacctcaagtatgctctttacatgccgctccgagagaccaggacaggttacggtaaatgcgataacacgtgccatggactttgcatgtctcccagcggcaaaagctggatgggccctggaacagatagggtcggttcttcctcaataccaggctgtcgaaaacgtgttgcatacttcgctgactaatatcgaagctgtattgcacccgctgccaacactgttaaacgctgctcgttgtgagtctggtaccccattccattattataccgaggggattacgccatcagtcggggcgcttgcggagaaagtggacgctgaacgcatagcaatcgcaaaggctttcgatttaaacgttccgtcggtctgcgaatggcataagattagttacggccagtcaccggccacaatttatgaagcggtgcagggtaatcctgctctgcgcggcattatgggacctaccagccttaacacggtgcacttcttcgaggatgtaagcaccggactggtaccgttatccgaactgggtcgggcagtgaatgtgcctaccccacttatcgatgctgttattctgttgatcagttcgctgatagacgtggatttcagaaaggaaggtcgtaccttggaaaaattaggtctgagcggacttaccgccgcggaaataagaagtgctgttgag

SEQ ID NO: 560 - protein, 359 aa, Artificial Sequence
  Engineered variant of opine dehydrogenase CENDH
MIESKTYAVLGLGNGGHAFAAYLALKGQRVLAWDIDAQRIKEIQDRGAIIAEGPGLAGTAHPDLLTSDIGLAVKDADVILIVVPAIHHASIAANIASYISEGQLIILNPGATGGALEFRKILRENGAPEVTIGETSSMLFTCRSERPGQVTVNAITRAMDFACLPAAKAGWALEQIGSVLPQYQAVENVLHTSLTNIEAVLHPLPTLLNAARCESGTPFHYYTEGITPSVGALAEKVDAERIAIAKAFDLNVPSVCEWHKISYGQSPATIYEAVQGNPALRGIMGPTSLNTVHFFEDVSTGLVPLSELGRAVNVPTPLIDAVILLISSLIDVDFRKEGRTLEKLGLSGLTAAEIRSAVE

SEQ ID NO: 561 - DNA, 1077 bp, Artificial Sequence
  Engineered variant of opine dehydrogenase CENDH
atgatcgagtcaaaaacatacgccgttttgggattaggaaacgggggtcacgcatttgccgcctatttagcattgaagggccagcgtgtactggcttgggacatcgatgctcagagaatcaaagagattcaggaccgtggagccatcatagcggaaggaccaggacttgctgggactgctcacccggatcttctgacctcagatataggtttggcggttaaagacgctgatgtgatactgattgtagtgccggccatccaccacgcttccattgcagcaaatatcgccagttacatttccgagggtcagttgattatccttaaccctggggcaacgggtggagcgctggaattccggaaaatcctgcgtgaaaatggtgcgccggaggtaacgatcggggaaacctcaagtatgctctttacatgccgctccgagagaccaggacaggttacggtaaattttatgacacgtgccatggactttgcatgtctcccagcggcaaaagctggatgggccctggaacagatagggtcggttcttcctcaataccaggctgtcgaaaacgtgttgcatacttcgctgactaatatcgaagctgtattgcacccgctgccaacactgttaaacgctgctcgttgtgagtctggtaccccattccattattataccgaggggattacgccatcagtcgggcgtcttgcggagaaagtggacgctgaacgcatagcaatcgcaaaggctttcgatttaaacgttccgtcggtcgtggaatggcataagattagttacggccagtcaccggccacaatttatgaagcggtgcagggtaatcctgctctgcgcggcattatgggacctaccagccttaacacggtgcacttcttcgaggatgtaagcaccggactggtaccgttatccgaactgggtcgggtggtgaatgtgcctaccccacttatcgatgctgttcttctgttgatcagttcgctgatagacgtggatttcagaaaggaaggtcgtaccttggaaaaattaggtctgagcggacttaccgccgcggaaataagaagtgctgttgag

SEQ ID NO: 562 - protein, 359 aa, Artificial Sequence
  Engineered variant of opine dehydrogenase CENDH
MIESKTYAVLGLGNGGHAFAAYLALKGQRVLAWDIDAQRIKEIQDRGAIIAEGPGLAGTAHPDLLTSDIGLAVKDADVILIVVPAIHHASIAANIASYISEGQLIILNPGATGGALEFRKILRENGAPEVTIGETSSMLFTCRSERPGQVTVNFMTRAMDFACLPAAKAGWALEQIGSVLPQYQAVENVLHTSLTNIEAVLHPLPTLLNAARCESGTPFHYYTEGITPSVGRLAEKVDAERIAIAKAFDLNVPSVVEWHKISYGQSPATIYEAVQGNPALRGIMGPTSLNTVHFFEDVSTGLVPLSELGRVVNVPTPLIDAVLLLISSLIDVDFRKEGRTLEKLGLSGLTAAEIRSAVE

SEQ ID NO: 563 - DNA, 1077 bp, Artificial Sequence
  Engineered variant of opine dehydrogenase CENDH
atgatcgagtcaaaaacatacgccgttttgggattaggaaacgggggtcacgcatttgccgcctatttagcattgaagggccagcgtgtactggcttgggacatcgatgctcagagaatcaaagagattcaggaccgtggagccatcatagcggaaggaccaggacttgctgggactgctcacccggatcttctgacctcagatataggtttggcggttaaagacgctgatgtgatactgattgtagtgccggccatccaccacgcttccattgcagcaaatatcgccagttacatttccgagggtcagttgattatccttaaccctggggcaacgggtggagcgctggaattccggaaaatcctgcgtgaaaatggtgcgccggaggtaacgatcggggaaacctcaagtatgctctttacatgccgctccgagagaccaggacaggttacggtaaatcagataacacgtgccatggactttgcatgtctcccagcggcaaaagctggatgggccctggaacagatagggtcggttcttcctcaataccaggctgtcgaaaacgtgttgcatacttcgctgactaatatcgaagctgtattgcacccgctgccaacactgttaaacgctgctcgttgtgagtctggtaccccattccattattataccgaggggattacgccatcagtcggggcgcttgcggagaaagtggacgctgaacgcatagcaatcgcaaaggctttcgatttaaacgttccgtcggtctgcgaatggcataagattagttacggccagtcaccggccacaatttatgaagcggtgcagggtaatcctgctctgcgcggcattatgggacctaccagccttaacacggtgcacttcttcgaggatgtaagcaccggactggtaccgttatccgaactgggtcgggtggtgaatgtgcctaccccacttatcgatgctgttcttctgttgatcagttcgctgatagacgtggatttcagaaaggaaggtcgtaccttggaaaaattaggtctgagcggacttaccgccgcggaaataagaagtgctgttgag

SEQ ID NO: 564 - protein, 359 aa, Artificial Sequence
  Engineered variant of opine dehydrogenase CENDH
MIESKTYAVLGLGNGGHAFAAYLALKGQRVLAWDIDAQRIKEIQDRGAIIAEGPGLAGTAHPDLLTSDIGLAVKDADVILIVVPAIHHASIAANIASYISEGQLIILNPGATGGALEFRKILRENGAPEVTIGETSSMLFTCRSERPGQVTVNQITRAMDFACLPAAKAGWALEQIGSVLPQYQAVENVLHTSLTNIEAVLHPLPTLLNAARCESGTPFHYYTEGITPSVGALAEKVDAERIAIAKAFDLNVPSVCEWHKISYGQSPATIYEAVQGNPALRGIMGPTSLNTVHFFEDVSTGLVPLSELGRVVNVPTPLIDAVLLLISSLIDVDFRKEGRTLEKLGLSGLTAAEIRSAVE

SEQ ID NO: 565 - DNA, 1077 bp, Artificial Sequence
  Engineered variant of opine dehydrogenase CENDH
atgatcgagtcaaaaacatacgccgttttgggattaggaaacgggggtcacgcatttgccgcctatttagcattgaagggccagcgtgtactggcttgggacatcgatgctcagagaatcaaagagattcaggaccgtggagccatcatagcggaaggaccaggacttgctgggactgctcacccggatcttctgacctcagatataggtttggcggttaaagacgctgatgtgatactgattgtagtgccggccatccaccacgcttccattgcagcaaatatcgccagttacatttccgagggtcagttgattatccttaaccctggggcaacgggtggagcgctggaattccggaaaatcctgcgtaacaatggtgcgccggaggtaacgatcggggaaacctcaagtatgctctttacatgccgctccgagagaccaggacaggttacggtaaatcagataacacgtgccatggactttgcatgtctcccagcggcaaaagctggatgggccctggaacagatatgctcggttcttcctcaataccaggctgtcgaaaacgtgttgcatacttcgctgactaatatcgaagctgtattgcacccgctgccaacactgttaaacgctgctcgttgtgagtctggtaccccattccattattataccgaggggattacgccatcagtcggggcgcttgcggagaaagtggacgctgaacgcatagcaatcgcaaaggctttcgatttaaacgttccgtcggtctgcgaatggcataagattagttacggccagtcaccggccacaatttatgaagcggtgcagggtaatcctgctctgcgcggcattatgggacctaccagccttaacacggtgcacttcttcgaggatgtaagcaccggactggtaccgttatccgaactgggtcgggcagtgaatgtgcctaccccacttatcgatgctgttcttctgttgatcagtgcgctgatagacgtggatttcagaaaggaaggtcgtaccttggaaaaattaggtctgagcggacttaccgccgcggaaataagaagtgctgttgag

SEQ ID NO: 566 - protein, 359 aa, Artificial Sequence
  Engineered variant of opine dehydrogenase CENDH
MIESKTYAVLGLGNGGHAFAAYLALKGQRVLAWDIDAQRIKEIQDRGAIIAEGPGLAGTAHPDLLTSDIGLAVKDADVILIVVPAIHHASIAANIASYISEGQLIILNPGATGGALEFRKILRNNGAPEVTIGETSSMLFTCRSERPGQVTVNQITRAMDFACLPAAKAGWALEQICSVLPQYQAVENVLHTSLTNIEAVLHPLPTLLNAARCESGTPFHYYTEGITPSVGALAEKVDAERIAIAKAFDLNVPSVCEWHKISYGQSPATIYEAVQGNPALRGIMGPTSLNTVHFFEDVSTGLVPLSELGRAVNVPTPLIDAVLLLISALIDVDFRKEGRTLEKLGLSGLTAAEIRSAVE

SEQ ID NO: 567 - DNA, 1077 bp, Artificial Sequence
  Engineered variant of opine dehydrogenase CENDH
atgatcgagtcaaaaacatacgccgttttgggattaggaaacgggggtcacgcatttgccgcctatttagcattgaagggccagcgtgtactggcttgggacatcgatgctcagagaatcaaagagattcaggaccgtggagccatcatagcggaaggaccaggacttgctgggactgctcacccggatcttctgacctcagatataggtttggcggttaaagacgctgatgtgatactgattgtagtgccggccatccaccacgcttccattgcagcaaatatcgccagttacatttccgagggtcagttgattatccttaaccctggggcaacgggtggagcgctggaattccggaaaatcctgcgtgaaaatggtgcgccggaggtaacgatcggggaaacctcaagtatgctctttacatgccgctccgagagaccaggacaggttacggtaaatcagataacacgtgccatggactttgcatgtctcccagcggcaaaagctggatgggccctggaacagatagggtcggttcttcctcaataccaggctgtcgaaaacgtgttgcatacttcgctgactaatatcgaagctgtattgcacccgctgccaacactgttaaacgctgctcgttgtgagtctggtaccccattccattattataccgaggggattacgccatcagtcggggcgcttgcggagaaagtggacgctgaacgcatagcaatcgcaaaggctttcgatttaaacgttccgtcggtctgcgaatggcataagattagttacggccagtcaccggccacaatttatgaagcggtgcagggtaatcctgctctgcgcggcattatgggacctaccagccttaacacggtgcacttcttcgaggatgtaagcaccggactggtaccgttatccgaactgggtcgggcagtgaatgtgcctaccccacttatcgatgctgttcttctgttgatcagtgaactgatagacgtggatttcagaaaggaaggtcgtaccttggaaaaattaggtctgagcggacttaccgccgcggaaataagaagtgctgttgag

SEQ ID NO: 568 - protein, 359 aa, Artificial Sequence
  Engineered variant of opine dehydrogenase CENDH
MIESKTYAVLGLGNGGHAFAAYLALKGQRVLAWDIDAQRIKEIQDRGAIIAEGPGLAGTAHPDLLTSDIGLAVKDADVILIVVPAIHHASIAANIASYISEGQLIILNPGATGGALEFRKILRENGAPEVTIGETSSMLFTCRSERPGQVTVNQITRAMDFACLPAAKAGWALEQIGSVLPQYQAVENVLHTSLTNIEAVLHPLPTLLNAARCESGTPFHYYTEGITPSVGALAEKVDAERIAIAKAFDLNVPSVCEWHKISYGQSPATIYEAVQGNPALRGIMGPTSLNTVHFFEDVSTGLVPLSELGRAVNVPTPLIDAVLLLISELIDVDFRKEGRTLEKLGLSGLTAAEIRSAVE

SEQ ID NO: 569 - DNA, 1077 bp, Artificial Sequence
  Engineered variant of opine dehydrogenase CENDH
atgatcgagtcaaaaacatacgccgttttgggattaggaaacgggggtcacgcatttgccgcctatttagcattgaagggccagcgtgtactggcttgggacatcgatgctcagagaatcaaagagattcaggaccgtggagccatcatagcggaaggaccaggacttgctgggactgctcacccggatcttctgacctcagatataggtttggcggttaaagacgctgatgtgatactgattgtagtgccggccatccaccacgcttccattgcagcaaccatcgccagttacatttccgagggtcagttgattatccttaaccctggggcaacgggtggagcgctggaattccggaaaatcctgcgtgaaaatggtgcgccggaggtaacgatcggggaaacctcaagtatgctctttacatgccgctccgagagaccaggacaggttacggtaaatgcgataacacgtgccatggactttgcatgtctcccagcggcaaaagctggatgggccctggaacagatagggtcggttcttcctcaataccaggctgtcgaaaacgtgttgcatacttcgctgactaatatcgaagctgtattgcacccgctgccaacactgttaaacgctgctcgttgtgagtctggtaccccattccattattataccgaggggattacgccatcagtcggggcgcttgcggagaaagtggacgctgaacgcatagcaatcgcaaaggctttcgatttaaacgttccgtcggtctgcgaatggcataagattagttacggcctgtcaccggccacaatttatgaagcggtgcagggtaatcctgctctgcgcggcattatgggacctaccagccttaacacggtgcacttcttcgaggatgtaagcaccggactggtaccgttatccgaatttggtcgggcagtgaatgtgcctaccccacttatcgatgctgttcttctgttgatcagttcgctgatagacgtggatttcagaaaggaaggtcgtaccttggaaaaattaggtctgagcggacttaccgccgcggaaataagaagtgctgttgag

SEQ ID NO: 570 - protein, 359 aa, Artificial Sequence
  Engineered variant of opine dehydrogenase CENDH
MIESKTYAVLGLGNGGHAFAAYLALKGQRVLAWDIDAQRIKEIQDRGAIIAEGPGLAGTAHPDLLTSDIGLAVKDADVILIVVPAIHHASIAATIASYISEGQLIILNPGATGGALEFRKILRENGAPEVTIGETSSMLFTCRSERPGQVTVNAITRAMDFACLPAAKAGWALEQIGSVLPQYQAVENVLHTSLTNIEAVLHPLPTLLNAARCESGTPFHYYTEGITPSVGALAEKVDAERIAIAKAFDLNVPSVCEWHKISYGLSPATIYEAVQGNPALRGIMGPTSLNTVHFFEDVSTGLVPLSEFGRAVNVPTPLIDAVLLLISSLIDVDFRKEGRTLEKLGLSGLTAAEIRSAVE

SEQ ID NO: 571 - DNA, 1077 bp, Artificial Sequence
  Engineered variant of opine dehydrogenase CENDH
atgatcgagtcaaaaacatacgccgttttgggattaggaaacgggggtcacgcatttgccgcctatttagcattgaagggccagcgtgtactggcttgggacatcgatgctcagagaatcaaagagattcaggaccgtggagccatcatagcggaaggaccaggacttgctgggactgctcacccggatcttctgacctcagatataggtttggcggttaaagacgctgatgtgatactgattgtagtgccggccatccaccacgcttccattgcagcaaatatcgccagttacatttccgagggtcagttgattatccttaaccctggggcaacgggtggagcgctggaattccggaaaatcctgcgtgaaaatggtgcgccggaggtaacgatcggggaaacctcaagtatgctctttacatgccgctccgagagaccaggacaggttacggtaaatgcgataacacgtgccatggactttgcatgtctcccagcggcaaaagctggatgggccctggaacagatagggtcggttcttcctcaataccaggctgtcgaaaacgtgttgcatacttcgctgactaatatcgaagctgtattgcacccgctgccaacactgttaaacgctgctcgttgtgagtctggtaccccattccattattataccgaggggattacgccatcagtcggggcgcttgcggagaaagtggacgctgaacgcatagcaatcgcaaaggctttcgatttaaacgttccgtcggtctgcgaatggcataagattagttacggccagtcaccggccacaatttatgaagcggtgcagggtaatcctgctctgcgcggcattatgggacctaccagccttaacacggtgcacttcttctgggatgtaagcaccggactggtaccgttatccgaactgggtcgggcagtgaatgtgcctaccccacttatcgatgctgttcttctgttgatcagttcgctgatagacgtggatttcagaaaggaaggtcgtaccttggaaaaattaggtctgagcggacttaccgccgcggaaataagaagtgctgttgag

SEQ ID NO: 572 - protein, 359 aa, Artificial Sequence
  Engineered variant of opine dehydrogenase CENDH
MIESKTYAVLGLGNGGHAFAAYLALKGQRVLAWDIDAQRIKEIQDRGAIIAEGPGLAGTAHPDLLTSDIGLAVKDADVILIVVPAIHHASIAANIASYISEGQLIILNPGATGGALEFRKILRENGAPEVTIGETSSMLFTCRSERPGQVTVNAITRAMDFACLPAAKAGWALEQIGSVLPQYQAVENVLHTSLTNIEAVLHPLPTLLNAARCESGTPFHYYTEGITPSVGALAEKVDAERIAIAKAFDLNVPSVCEWHKISYGQSPATIYEAVQGNPALRGIMGPTSLNTVHFFWDVSTGLVPLSELGRAVNVPTPLIDAVLLLISSLIDVDFRKEGRTLEKLGLSGLTAAEIRSAVE

SEQ ID NO: 573 - DNA, 1077 bp, Artificial Sequence
  Engineered variant of opine dehydrogenase CENDH
atgatcgagtcaaaaacatacgccgttttgggattaggaaacgggggtcacgcatttgccgcctatttagcattgaagggccagcgtgtactggcttgggacatcgatgctcagagaatcaaagagattcaggaccgtggagccatcatagcggaaggaccaggacttgctgggactgctcacccggatcttctgacctcagatataggtttggcggttaaagacgctgatgtgatactgattgtagtgccggccatccaccacgcttccattgcagcaaatatcgccagttacatttccgagggtcagttgattatccttaaccctggggcaacgggtggagcgctggaattccggaaaatcctgcgtgaaaatggtgcgccggaggtaacgatcggggaaacctcaagtatgctctttacatgccgctccgagagaccaggacaggttacggtaaatgcgataacacgtgccatggactttgcatgtctcccagcggcaaaagctggatgggccctggaacagatagggtcggttcttcctcaataccaggctgtcgaaaacgtgttgcatacttcgctgactaatatcgaagctgtattgcacccgctgccaacactgttaaacgctgctcgttgtgagtctggtaccccattccattattataccgaggggattacgccatcagtcggggcgcttgcggagaaagtggacgctgaacgcatagcaatcgcaaaggctttcgatttaaacgttccgtcggtctgcgaatggcataagattagttacggccagtcaccggccacaggttatgaagcggtgcagggtaatcctgctctgcgcggcattatgggacctaccagccttaacacggtgcacttcttcgaggatgtaagcaccggactggtaccgttatccgaactgggtcgggcagtgaatgtgcctaccccacttatcgatgctgttcttctgttgatcagttcgctgatagacgtggatttcagaaaggaaggtcgtaccttggaaaaattaggtctgagcggacttaccgccgcggaaataagaagtgctgttgag

SEQ ID NO: 574 - protein, 359 aa, Artificial Sequence
  Engineered variant of opine dehydrogenase CENDH
MIESKTYAVLGLGNGGHAFAAYLALKGQRVLAWDIDAQRIKEIQDRGAIIAEGPGLAGTAHPDLLTSDIGLAVKDADVILIVVPAIHHASIAANIASYISEGQLIILNPGATGGALEFRKILRENGAPEVTIGETSSMLFTCRSERPGQVTVNAITRAMDFACLPAAKAGWALEQIGSVLPQYQAVENVLHTSLTNIEAVLHPLPTLLNAARCESGTPFHYYTEGITPSVGALAEKVDAERIAIAKAFDLNVPSVCEWHKISYGQSPATGYEAVQGNPALRGIMGPTSLNTVHFFEDVSTGLVPLSELGRAVNVPTPLIDAVLLLISSLIDVDFRKEGRTLEKLGLSGLTAAEIRSAVE

SEQ ID NO: 575 - DNA, 1077 bp, Artificial Sequence
  Engineered variant of opine dehydrogenase CENDH
atgatcgagtcaaaaacatacgccgttttgggattaggaaacgggggtcacgcatttgccgcctatttagcattgaagggccagcgtgtactggcttgggacatcgatgctcagagaatcaaagagattcaggaccgtggagccatcatagcggaaggaccaggacttgctgggactgctcacccggatcttctgacctcagatataggtttggcggttaaagacgctgatgtgatactgattgtagtgccggccatccaccacgcttccattgcagcaaaaatcgccagttacatttccgagggtcagttgattatccttaaccctggggcaacgggtggagcgctggaattccggaaaatcctgcgtgaaaatggtgcgccggaggtaacgatcggggaaacctcaagtatgctctttacatgccgctccgagagaccaggacaggttacggtaaatgcgataacacgtgccatggactttgcatgtctcccagcggcaaaagctggatgggccctggaacagatagggtcggttcttcctcaatgccaggctgtcgaaaacgtgttgcatacttcgctgactaatatcgaagctgtattgcacccgctgccaacactgttaaacgctgctcgttgtgagtctggtaccccattccattattataccgaggggattacgccatcagtcggggcgcttgcggagaaagtggacgctgaacgcatagcaatcgcaaaggctttcgatttaaacgttccgtcggtctgcgaatggcataagattagttacggcggctcaccggccacaatttatgaagcggtgcagggtaatcctgctctgcgcggcattatgggacctaccagccttaacacggtgcacgcgttcgaggatgtaagcaccggactggtaccgttatccgaactgggtcgggcagtgaatgtgcctaccccacttatcgatgctgttcttctgttgatcagttcgctgatagacgtggatttcagaaaggaaggtcgtaccttggaaaaattaggtctgagcggacttaccgccgcggaaataagaagtgctgttgag

SEQ ID NO: 576 - protein, 359 aa, Artificial Sequence
  Engineered variant of opine dehydrogenase CENDH
MIESKTYAVLGLGNGGHAFAAYLALKGQRVLAWDIDAQRIKEIQDRGAIIAEGPGLAGTAHPDLLTSDIGLAVKDADVILIVVPAIHHASIAAKIASYISEGQLIILNPGATGGALEFRKILRENGAPEVTIGETSSMLFTCRSERPGQVTVNAITRAMDFACLPAAKAGWALEQIGSVLPQCQAVENVLHTSLTNIEAVLHPLPTLLNAARCESGTPFHYYTEGITPSVGALAEKVDAERIAIAKAFDLNVPSVCEWHKISYGGSPATIYEAVQGNPALRGIMGPTSLNTVHAFEDVSTGLVPLSELGRAVNVPTPLIDAVLLLISSLIDVDFRKEGRTLEKLGLSGLTAAEIRSAVE

SEQ ID NO: 577 - DNA, 1077 bp, Artificial Sequence
  Engineered variant of opine dehydrogenase CENDH
atgatcgagtcaaaaacatacgccgttttgggattaggaaacgggggtcacgcatttgccgcctatttagcattgaagggccagcgtgtactggcttgggacatcgatgctcagagaatcaaagagattcaggaccgtggagccatcatagcggaaggaccaggacttgctgggactgctcacccggatcttctgacctcagatataggtttggcggttaaagacgctgatgtgatactgattgtagtgccggccatccaccacgcttccattgcagcacgtatcgccagttacatttccgagggtcagttgattatccttaaccctggggcaacgggtggagcgctggaattccggaaaatcctgcgtgaaaatggtgcgccggaggtaacgatcggggaaacctcaagtatgctctttacatgccgctccgagagaccaggacaggttacggtaaatgcgataacacgtgccatggactttgcatgtctcccagcggcaaaagctggatgggccctggaacagatagggtcggttcttcctcaataccaggctgtcgaaaacgtgttgcatacttcgctgactaatatcgaagctgtattgcacccgctgccaacactgttaaacgctgctcgttgtgagtctggtaccccattccattattataccgaggggattacgccatcagtcggggcgcttgcggagaaagtggacgctgaacgcatagcaatcgcaaaggctttcgatttaaacgttccgtcggtctgcgaatgggttaagattagttacggccagtcaccggccacaatttatgaagcggtgcagggtaatccttttctgcgcggcattatgggacctaccagccttaacacggtgcacttcttcgaggatgtaagcaccggactggtaccgttatccgaactgggtcgggcagtgaatgtgcctaccccacttatcgatgctgttcttctgttgatcagttcgctgatagacgtggatttcagaaaggaaggtcgtaccttggaaaaattaggtctgagcggacttaccgccgcggaaataagaagtgctgttgag

SEQ ID NO: 578 - protein, 359 aa, Artificial Sequence
  Engineered variant of opine dehydrogenase CENDH
MIESKTYAVLGLGNGGHAFAAYLALKGQRVLAWDIDAQRIKEIQDRGAIIAEGPGLAGTAHPDLLTSDIGLAVKDADVILIVVPAIHHASIAARIASYISEGQLIILNPGATGGALEFRKILRENGAPEVTIGETSSMLFTCRSERPGQVTVNAITRAMDFACLPAAKAGWALEQIGSVLPQYQAVENVLHTSLTNIEAVLHPLPTLLNAARCESGTPFHYYTEGITPSVGALAEKVDAERIAIAKAFDLNVPSVCEWVKISYGQSPATIYEAVQGNPFLRGIMGPTSLNTVHFFEDVSTGLVPLSELGRAVNVPTPLIDAVLLLISSLIDVDFRKEGRTLEKLGLSGLTAAEIRSAVE

SEQ ID NO: 579 - DNA, 1077 bp, Artificial Sequence
  Engineered variant of opine dehydrogenase CENDH
atgatcgagtcaaaaacatacgccgttttgggattaggaaacgggggtcacgcatttgccgcctatttagcattgaagggccagcgtgtactggcttgggacatcgatgctcagagaatcaaagagattcaggaccgtggagccatcatagcggaaggaccaggacttgctgggactgctcacccggatcttctgacctcagatataggtttggcggttaaagacgctgatgtgatactgattgtagtgccggccatccaccacgcttccattgcagcaaaaatcgccagttacatttccgagggtcagttgattatccttaaccctgggcgtacgggtggagcgctggaattccggaaaatcctgcgtgaaaatggtgcgccggaggtaacgatcggggaaacctcaagtatgctctttacatgccgctccgagagaccaggacaggttacggtaaattatataacacgtgccatggactttgcatgtctcccagcggcaaaagctggatgggccctggaacagatagggtcggttcttcctcaataccaggctgtcgaaaacgtgttgcatacttcgctgactaatatcgaagctgtattgcacccgctgccaacactgttaaacgctgctcgttgtgagtctggtaccccattccattattataccgaggggattacgccatcagtcggggcgcttgcggagaaagtggacgctgaacgcatagcaatcgcaaaggctttcgatttaaacgttccgtcggtctgcgaatgggttaagattagttacggccagtcaccggccacaatttatgaagcggtgcagggtaatcctgtgctgcgcggcattatgggacctaccagccttaacacggtgcacttcttcgaggatgtaagcaccggactggtaccgttatccgaactgggtcgggcagtgaatgtgcctaccccacttatcgatgctgttcttctgttgatcagttcgctgatagacgtggatttcagaaaggaaggtcgtaccttggaaaaattaggtctgagcggacttaccgccgcggaaataagaagtgctgttgag

SEQ ID NO: 580 - protein, 359 aa, Artificial Sequence
  Engineered variant of opine dehydrogenase CENDH
MIESKTYAVLGLGNGGHAFAAYLALKGQRVLAWDIDAQRIKEIQDRGAIIAEGPGLAGTAHPDLLTSDIGLAVKDADVILIVVPAIHHASIAAKIASYISEGQLIILNPGRTGGALEFRKILRENGAPEVTIGETSSMLFTCRSERPGQVTVNYITRAMDFACLPAAKAGWALEQIGSVLPQYQAVENVLHTSLTNIEAVLHPLPTLLNAARCESGTPFHYYTEGITPSVGALAEKVDAERIAIAKAFDLNVPSVCEWVKISYGQSPATIYEAVQGNPVLRGIMGPTSLNTVHFFEDVSTGLVPLSELGRAVNVPTPLIDAVLLLISSLIDVDFRKEGRTLEKLGLSGLTAAEIRSAVE

SEQ ID NO: 581 - DNA, 1077 bp, Artificial Sequence
  Engineered variant of opine dehydrogenase CENDH
atgatcgagtcaaaaacatacgccgttttgggattaggaaacgggggtcacgcatttgccgcctatttagcattgaagggccagcgtgtactggcttgggacatcgatgctcagagaatcaaagagattcaggaccgtggagccatcatagcggaaggaccaggacttgctgggactgctcacccggatcttctgacctcagatataggtttggcggttaaagacgctgatgtgatactgattgtagtgccggccatccaccacgcttccattgcagcaaatatcgccagttacatttccgagggtcagttgattatccttaaccctggggcaacgggtggagcgctggaattccggaaaatcctgcgtgaaaatggtgcgccggaggtaacgatcggggaaacctcaaacatgctctttacatgccgctccgagagaccaggacaggttacggtaaatgcgataacacgtgccatggactttgcatgtctcccagcggcaaaagctggatgggccctggaacagatagggtcggttcttcctcaataccaggctgtcgaaaacgtgttgcatacttcgctgactaatatcgaagctgtattgcacccgctgccaacactgttaaacgctgctcgttgtgagtctggtaccccattccattattataccgaggggattacgccatcagtcggggcgcttgcggagaaagtggacgctgaacgcatagcaatcgcaaaggctttcgatttaaacgttccgtcggtctgcgaatgggttaagattagttacggccagtcaccggccacaatttatgaagcggtgcagggtaatcctgtgctgcgcggcattatgggacctaccagccttaacacggtgcacttcttcgaggatgtaagcaccggactggtaccgttatccgaactgggtcgggcagtgaatgtgcctaccccacttatcgatgctgttcttctgttgatcagttcgctgatagacgtggatttcagaaaggaaggtcgtaccttggaaaaattaggtctgagcggacttaccgccgcggaaataagaagtgctgttgag

SEQ ID NO: 582 - protein, 359 aa, Artificial Sequence
  Engineered variant of opine dehydrogenase CENDH
MIESKTYAVLGLGNGGHAFAAYLALKGQRVLAWDIDAQRIKEIQDRGAIIAEGPGLAGTAHPDLLTSDIGLAVKDADVILIVVPAIHHASIAANIASYISEGQLIILNPGATGGALEFRKILRENGAPEVTIGETSNMLFTCRSERPGQVTVNAITRAMDFACLPAAKAGWALEQIGSVLPQYQAVENVLHTSLTNIEAVLHPLPTLLNAARCESGTPFHYYTEGITPSVGALAEKVDAERIAIAKAFDLNVPSVCEWVKISYGQSPATIYEAVQGNPVLRGIMGPTSLNTVHFFEDVSTGLVPLSELGRAVNVPTPLIDAVLLLISSLIDVDFRKEGRTLEKLGLSGLTAAEIRSAVE

SEQ ID NO: 583 - DNA, 1077 bp, Artificial Sequence
  Engineered variant of opine dehydrogenase CENDH
atgatcgagtcaaaaacatacgccgttttgggattaggaaacgggggtcacgcatttgccgcctatttagcattgaagggccagcgtgtactggcttgggacatcgatgctcagagaatcaaagagattcaggaccgtggagccatcatagcggaaggaccaggacttgctgggactgctcacccggatcttctgacctcagatataggtttggcggttaaagacgctgatgtgatactgattgtagtgccggccatccaccacgcttccattgcagcaaaaatcgccagttacatttccgagggtcagttgattatccttaaccctgggcgtacgggtggagcgctggaattccggaaaatcctgcgtgaaaatggtgcgccggaggtaacgatcggggaaacctcaagtatgctctttacatgccgctccgagagaccaggacaggttacggtaaatgcgataacacgtgccatggactttgcatgtctcccagcggcaaaagctggatgggccctggaacagatagggtcggttcttcctcaataccaggctgtcgaaaacgtgttgcatacttcgctgactaatatcgaagctgtattgcacccgctgccaacactgttaaacgctgctcgttgtgagtctggtaccccattccattattataccgaggggattacgccatcagtcggggcgcttgcggagaaagtggacgctgaacgcatagcaatcgcaaaggctttcgatttaaacgttccgtcggtctgcgaatgggttaagattagttacggccagtcaccggccacaatttatgaagcggtgcagggtaatccttttctgcgcggcattatgggacctaccagccttaacacggtgcacttcttcgaggatgtaagcaccggactggtaccgttatccgaactgggtcgggcagtgaatgtgcctaccccacttatcgatgctgttcttctgttgatcagttcgctgatagacgtggatttcagaaaggaaggtcgtaccttggaaaaattaggtctgagcggacttaccgccgcggaaataagaagtgctgttgag

SEQ ID NO: 584 - protein, 359 aa, Artificial Sequence
  Engineered variant of opine dehydrogenase CENDH
MIESKTYAVLGLGNGGHAFAAYLALKGQRVLAWDIDAQRIKEIQDRGAIIAEGPGLAGTAHPDLLTSDIGLAVKDADVILIVVPAIHHASIAAKIASYISEGQLIILNPGRTGGALEFRKILRENGAPEVTIGETSSMLFTCRSERPGQVTVNAITRAMDFACLPAAKAGWALEQIGSVLPQYQAVENVLHTSLTNIEAVLHPLPTLLNAARCESGTPFHYYTEGITPSVGALAEKVDAERIAIAKAFDLNVPSVCEWVKISYGQSPATIYEAVQGNPFLRGIMGPTSLNTVHFFEDVSTGLVPLSELGRAVNVPTPLIDAVLLLISSLIDVDFRKEGRTLEKLGLSGLTAAEIRSAVE

SEQ ID NO: 585 - DNA, 1077 bp, Artificial Sequence
  Engineered variant of opine dehydrogenase CENDH
atgatcgagtcaaaaacatacgccgttttgggattaggaaacgggggtcacgcatttgccgcctatttagcattgaagggccagcgtgtactggcttgggacatcgatgctcagagaatcaaagagattcaggaccgtggagccatcatagcggaaggaccaggacttgctgggactgctcacccggatcttctgacctcagatataggtttggcggttaaagacgctgatgtgatactgattgtagtgccggccatccaccacgcttccattgcagcacgtatcgccagttacatttccgagggtcagttgattatccttaaccctggggcaacgggtggagcgctggaattccggaaaatcctgcgtgaaaatggtgcgccggaggtaacgatcggggaaacctcaagtatgctctttacatgccgctccgagagaccaggacaggttacggtaaatgcgataacacgtgccatggactttgcatgtctcccagcggcaaaagctggatgggccctggaacagatagggtcggttcttcctcaataccaggctgtcgaaaacgtgttgcatacttcgctgactaatatcgaagctgtattgcacccgctgccaacactgttaaacgctgctcgttgtgagtctggtaccccattccattattataccgaggggattacgccatcagtcggggcgcttgcggagaaagtggacgctgaacgcatagcaatcgcaaaggctttcgatttaaacgttccgtcggtctgcgaatgggttaagattagttacggccagtcaccggccacaatttatgaagcggtgcagggtaatcctgtgctgcgcggcattatgggacctaccagccttaacacggtgcacttcttcgaggatgtaagcaccggactggtaccgttatccgaactgggtcgggcagtgaatgtgcctaccccacttatcgatgctgttcttctgttgatcagttcgctgatagacgtggatttcagaaaggaaggtcgtaccttggaaaaattaggtctgagcggacttaccgccgcggaaataagaagtgctgttgag

SEQ ID NO: 586 - protein, 359 aa, Artificial Sequence
  Engineered variant of opine dehydrogenase CENDH
MIESKTYAVLGLGNGGHAFAAYLALKGQRVLAWDIDAQRIKEIQDRGAIIAEGPGLAGTAHPDLLTSDIGLAVKDADVILIVVPAIHHASIAARIASYISEGQLIILNPGATGGALEFRKILRENGAPEVTIGETSSMLFTCRSERPGQVTVNAITRAMDFACLPAAKAGWALEQIGSVLPQYQAVENVLHTSLTNIEAVLHPLPTLLNAARCESGTPFHYYTEGITPSVGALAEKVDAERIAIAKAFDLNVPSVCEWVKISYGQSPATIYEAVQGNPVLRGIMGPTSLNTVHFFEDVSTGLVPLSELGRAVNVPTPLIDAVLLLISSLIDVDFRKEGRTLEKLGLSGLTAAEIRSAVE

SEQ ID NO: 587 - DNA, 1077 bp, Artificial Sequence
  Engineered variant of opine dehydrogenase CENDH
atgatcgagtcaaaaacatacgccgttttgggattaggaaacgggggtcacgcatttgccgcctatttagcattgaagggccagcgtgtactggcttgggacatcgatgctcagagaatcaaagagattcaggaccgtggagccatcatagcggaaggaccaggacttgctgggactgctcacccggatcttctgacctcagatataggtttggcggttaaagacgctgatgtgatactgattgtagtgccggccatccaccacgcttccattgcagcacgtatcgccagttacatttccgagggtcagttgattatccttaaccctggggcaacgggtggagcgctggaattccggaaaatcctgcgtgaaaatggtgcgccggaggtaacgatcggggaaacctcaagtatgctctttacatgccgctccgagagaccaggacaggttacggtaaattatataacacgtgccatggactttgcatgtctcccagcggcaaaagctggatgggccctggaacagatagggtcggttcttcctcaataccaggctgtcgaaaacgtgttgcatacttcgctgactaatatcgaagctgtattgcacccgctgccaacactgttaaacgctgctcgttgtgagtctggtaccccattccattattataccgaggggattacgccatcagtcggggcgcttgcggagaaagtggacgctgaacgcatagcaatcgcaaaggctttcgatttaaacgttccgtcggtctgcgaatgggttaagattagttacggccagtcaccggccacaatttatgaagcggtgcagggtaatccttttctgcgcggcattatgggacctaccagccttaacacggtgcacttcttctgggatgtaagcaccggactggtaccgttatccgaactgggtcgggcagtgaatgtgcctaccccacttatcgatgctgttcttctgttgatcagttcgctgatagacgtggatttcagaaaggaaggtcgtaccttggaaaaattaggtctgagcggacttaccgccgcggaaataagaagtgctgttgag

SEQ ID NO: 588 - protein, 359 aa, Artificial Sequence
  Engineered variant of opine dehydrogenase CENDH
MIESKTYAVLGLGNGGHAFAAYLALKGQRVLAWDIDAQRIKEIQDRGAIIAEGPGLAGTAHPDLLTSDIGLAVKDADVILIVVPAIHHASIAARIASYISEGQLIILNPGATGGALEFRKILRENGAPEVTIGETSSMLFTCRSERPGQVTVNYITRAMDFACLPAAKAGWALEQIGSVLPQYQAVENVLHTSLTNIEAVLHPLPTLLNAARCESGTPFHYYTEGITPSVGALAEKVDAERIAIAKAFDLNVPSVCEWVKISYGQSPATIYEAVQGNPFLRGIMGPTSLNTVHFFWDVSTGLVPLSELGRAVNVPTPLIDAVLLLISSLIDVDFRKEGRTLEKLGLSGLTAAEIRSAVE

SEQ ID NO: 589 - DNA, 1077 bp, Artificial Sequence
  Engineered variant of opine dehydrogenase CENDH
atgatcgagtcaaaaacatacgccgttttgggattaggaaacgggggtcacgcatttgccgcctatttagcattgaagggccagcgtgtactggcttgggacatcgatgctcagagaatcaaagagattcaggaccgtggagccatcatagcggaaggaccaggacttgctgggactgctcacccggatcttctgacctcagatataggtttggcggttaaagacgctgatgtgatactgattgtagtgccggccatccaccacgcttccattgcagcacgtatcgccagttacatttccgagggtcagttgattatccttaaccctgggcgtacgggtggagcgctggaattccggaaaatcctgcgtgaaaatggtgcgccggaggtaacgatcggggaaacctcaagtatgctctttacatgccgctccgagagaccaggacaggttacggtaaatgcgataacacgtgccatggactttgcatgtctcccagcggcaaaagctggatgggccctggaacagatagggtcggttcttcctcaataccaggctgtcgaaaacgtgttgcatacttcgctgactaatatcgaagctgtattgcacccgctgccaacactgttaaacgctgctcgttgtgagtctggtaccccattccattattataccgaggggattacgccatcagtcggggcgcttgcggagaaagtggacgctgaacgcatagcaatcgcaaaggctttcgatttaaacgttccgtcggtctgcgaatgggttaagattagttacggccagtcaccggccacaatttatgaagcggtgcagggtaatcctgtgctgcgcggcattatgggacctaccagccttaacacggtgcacttcttcgaggatgtaagcaccggactggtaccgttatccgaactgggtcgggcagtgaatgtgcctaccccacttatcgatgctgttcttctgttgatcagttcgctgatagacgtggatttcagaaaggaaggtcgtaccttggaaaaattaggtctgagcggacttaccgccgcggaaataagaagtgctgttgag

SEQ ID NO: 590 - protein, 359 aa, Artificial Sequence
  Engineered variant of opine dehydrogenase CENDH
MIESKTYAVLGLGNGGHAFAAYLALKGQRVLAWDIDAQRIKEIQDRGAIIAEGPGLAGTAHPDLLTSDIGLAVKDADVILIVVPAIHHASIAARIASYISEGQLIILNPGRTGGALEFRKILRENGAPEVTIGETSSMLFTCRSERPGQVTVNAITRAMDFACLPAAKAGWALEQIGSVLPQYQAVENVLHTSLTNIEAVLHPLPTLLNAARCESGTPFHYYTEGITPSVGALAEKVDAERIAIAKAFDLNVPSVCEWVKISYGQSPATIYEAVQGNPVLRGIMGPTSLNTVHFFEDVSTGLVPLSELGRAVNVPTPLIDAVLLLISSLIDVDFRKEGRTLEKLGLSGLTAAEIRSAVE

SEQ ID NO: 591 - DNA, 1077 bp, Artificial Sequence
  Engineered variant of opine dehydrogenase CENDH
atgatcgagtcaaaaacatacgccgttttgggattaggaaacgggggtcacgcatttgccgcctatttagcattgaagggccagcgtgtactggcttgggacatcgatgctcagagaatcaaagagattcaggaccgtggagccatcatagcggaaggaccaggacttgctgggactgctcacccggatcttctgacctcagatataggtttggcggttaaagacgctgatgtgatactgattgtagtgccggccatccaccacgcttccattgcagcaaaaatcgccagttacatttccgagggtcagttgattatccttaaccctggggcaacgggtggagcgctggaattccggaaaatcctgcgtgaaaatggtgcgccggaggtaacgatcggggaaacctcaagtatgctctttacatgccgctccgagagaccaggacaggttacggtaaatgcgataacacgtgccatggactttgcatgtctcccagcggcaaaagctggatgggccctggaacagatagggtcggttcttcctcaataccaggctgtcgaaaacgtgttgcatacttcgctgactaatatcgaagctgtattgcacccgctgccaacactgttaaacgctgctcgttgtgagtctggtaccccattccattattataccgaggggattacgccatcagtcggggcgcttgcggagaaagtggacgctgaacgcatagcaatcgcaaaggctttcgatttaaacgttccgtcggtctgcgaatgggttaagattagttacggccagtcaccggccacaatttatgaagcggtgcagggtaatccttttctgcgcggcattatgggacctaccagccttaacacggtgcacttcttcgaggatgtaagcaccggactggtaccgttatccgaactgggtcgggcagtgaatgtgcctaccccacttatcgatgctgttcttctgttgatcagttcgctgatagacgtggatttcagaaaggaaggtcgtaccttggaaaaattaggtctgagcggacttaccgccgcggaaataagaagtgctgttgag

SEQ ID NO: 592 - protein, 359 aa, Artificial Sequence
  Engineered variant of opine dehydrogenase CENDH
MIESKTYAVLGLGNGGHAFAAYLALKGQRVLAWDIDAQRIKEIQDRGAIIAEGPGLAGTAHPDLLTSDIGLAVKDADVILIVVPAIHHASIAAKIASYISEGQLIILNPGATGGALEFRKILRENGAPEVTIGETSSMLFTCRSERPGQVTVNAITRAMDFACLPAAKAGWALEQIGSVLPQYQAVENVLHTSLTNIEAVLHPLPTLLNAARCESGTPFHYYTEGITPSVGALAEKVDAERIAIAKAFDLNVPSVCEWVKISYGQSPATIYEAVQGNPFLRGIMGPTSLNTVHFFEDVSTGLVPLSELGRAVNVPTPLIDAVLLLISSLIDVDFRKEGRTLEKLGLSGLTAAEIRSAVE

SEQ ID NO: 593 - DNA, 1077 bp, Artificial Sequence
  Engineered variant of opine dehydrogenase CENDH
atgatcgagtcaaaaacatacgccgttttgggattaggaaacgggggtcacgcatttgccgcctatttagcattgaagggccagcgtgtactggcttgggacatcgatgctcagagaatcaaagagattcaggaccgtggagccatcatagcggaaggaccaggacttgctgggactgctcacccggatcttctgacctcagatataggtttggcggttaaagacgctgatgtgatactgattgtagtgccggccatccaccacgcttccattgcagcacgtatcgccagttacatttccgagggtcagttgattatccttaaccctgggcgtacgggtggagcgctggaattccggaaaatcctgcgtgaaaatggtgcgccggaggtaacgatcggggaaacctcaaacatgctctttacatgccgctccgagagaccaggacaggttacggtaaatgcgataacacgtgccatggactttgcatgtctcccagcggcaaaagctggatgggccctggaacagatagggtcggttcttcctcaataccaggctgtcgaaaacgtgttgcatacttcgctgactaatatcgaagctgtattgcacccgctgccaacactgttaaacgctgctcgttgtgagtctggtaccccattccattattataccgaggggattacgccatcagtcggggcgcttgcggagaaagtggacgctgaacgcatagcaatcgcaaaggctttcgatttaaacgttccgtcggtctgcgaatgggttaagattagttacggccagtcaccggccacaatttatgaagcggtgcagggtaatcctgttctgcgcggcattatgggacctaccagccttaacacggtgcacttcttcgaggatgtaagcaccggactggtaccgttatccgaactgggtcgggcagtgaatgtgcctaccccacttatcgatgctgttcttctgttgatcagttcgctgatagacgtggatttcagaaaggaaggtcgtaccttggaaaaattaggtctgagcggacttaccgccgcggaaataagaagtgctgttgag

SEQ ID NO: 594 - protein, 359 aa, Artificial Sequence
  Engineered variant of opine dehydrogenase CENDH
MIESKTYAVLGLGNGGHAFAAYLALKGQRVLAWDIDAQRIKEIQDRGAIIAEGPGLAGTAHPDLLTSDIGLAVKDADVILIVVPAIHHASIAARIASYISEGQLIILNPGRTGGALEFRKILRENGAPEVTIGETSNMLFTCRSERPGQVTVNAITRAMDFACLPAAKAGWALEQIGSVLPQYQAVENVLHTSLTNIEAVLHPLPTLLNAARCESGTPFHYYTEGITPSVGALAEKVDAERIAIAKAFDLNVPSVCEWVKISYGQSPATIYEAVQGNPVLRGIMGPTSLNTVHFFEDVSTGLVPLSELGRAVNVPTPLIDAVLLLISSLIDVDFRKEGRTLEKLGLSGLTAAEIRSAVE

SEQ ID NO: 595 - DNA, 1077 bp, Artificial Sequence
  Engineered variant of opine dehydrogenase CENDH
atgatcgagtcaaaaacatacgccgttttgggattaggaaacgggggtcacgcatttgccgcctatttagcattgaagggccagcgtgtactggcttgggacatcgatgctcagagaatcaaagagattcaggaccgtggagccatcatagcggaaggaccaggacttgctgggactgctcacccggatcttctgacctcagatataggtttggcggttaaagacgctgatgtgatactgattgtagtgccggccatccaccacgcttccattgcagcaaaaatcgccagttacatttccgagggtcagttgattatccttaaccctggggcaacgggtggagcgctggaattccggaaaatcctgcgtgaaaatggtgcgccggaggtaacgatcggggaaacctcaagtatgctctttacatgccgctccgagagaccaggacaggttacggtaaatgcgataacacgtgccatggactttgcatgtctcccagcggcaaaagctggatgggccctggaacagatagggtcggttcttcctcaataccaggctgtcgaaaacgtgttgcatacttcgctgactaatatcgaagctgtattgcacccgctgccaacactgttaaacgctgctcgttgtgagtctggtaccccattccattattataccgaggggattacgccatcagtcggggcgcttgcggagaaagtggacgctgaacgcatagcaatcgcaaaggctttcgatttaaacgttccgtcggtctgcgaatgggttaagattagttacggccagtcaccggccacaatttatgaagcggtgcagggtaatccttttctgcgcggcattatgggacctaccagccttaacacggtgcacttcttctgggatgtaagcaccggactggtaccgttatccgaactgggtcgggcagtgaatgtgcctaccccacttatcgatgctgttcttctgttgatcagttcgctgatagacgtggatttcagaaaggaaggtcgtaccttggaaaaattaggtctgagcggacttaccgccgcggaaataagaagtgctgttgag

SEQ ID NO: 596 - protein, 359 aa, Artificial Sequence
  Engineered variant of opine dehydrogenase CENDH
MIESKTYAVLGLGNGGHAFAAYLALKGQRVLAWDIDAQRIKEIQDRGAIIAEGPGLAGTAHPDLLTSDIGLAVKDADVILIVVPAIHHASIAAKIASYISEGQLIILNPGATGGALEFRKILRENGAPEVTIGETSSMLFTCRSERPGQVTVNAITRAMDFACLPAAKAGWALEQIGSVLPQYQAVENVLHTSLTNIEAVLHPLPTLLNAARCESGTPFHYYTEGITPSVGALAEKVDAERIAIAKAFDLNVPSVCEWVKISYGQSPATIYEAVQGNPFLRGIMGPTSLNTVHFFWDVSTGLVPLSELGRAVNVPTPLIDAVLLLISSLIDVDFRKEGRTLEKLGLSGLTAAEIRSAVE

SEQ ID NO: 597 - DNA, 1077 bp, Artificial Sequence
  Engineered variant of opine dehydrogenase CENDH
atgatcgagtcaaaaacatacgccgttttgggattaggaaacgggggtcacgcatttgccgcctatttagcattgaagggccagcgtgtactggcttgggacatcgatgctcagagaatcaaagagattcaggaccgtggagccatcatagcggaaggaccaggacttgctgggactgctcacccggatcttctgacctcagatataggtttggcggttaaagacgctgatgtgatactgattgtagtgccggccatccaccacgcttccattgcagcaaaaatcgccagttacatttccgagggtcagttgattatccttaaccctgggcgtacgggtggagcgctggaattccggaaaatcctgcgtgaaaatggtgcgccggaggtaacgatcggggaaacctcaaacatgctctttacatgccgctccgagagaccaggacaggttacggtaaatgcgataacacgtgccatggactttgcatgtctcccagcggcaaaagctggatgggccctggaacagatagggtcggttcttcctcaataccaggctgtcgaaaacgtgttgcatacttcgctgactaatatcgaagctgtattgcacccgctgccaacactgttaaacgctgctcgttgtgagtctggtaccccattccattattataccgaggggattacgccatcagtcggggcgcttgcggagaaagtggacgctgaacgcatagcaatcgcaaaggctttcgatttaaacgttccgtcggtctgcgaatgggttaagattagttacggccagtcaccggccacaatttatgaagcggtgcagggtaatcctgtgctgcgcggcattatgggacctaccagccttaacacggtgcacttcttcgaggatgtaagcaccggactggtaccgttatccgaactgggtcgggcagtgaatgtgcctaccccacttatcgatgctgttcttctgttgatcagttcgctgatagacgtggatttcagaaaggaaggtcgtaccttggaaaaattaggtctgagcggacttaccgccgcggaaataagaagtgctgttgag

SEQ ID NO: 598 - protein, 359 aa, Artificial Sequence
  Engineered variant of opine dehydrogenase CENDH
MIESKTYAVLGLGNGGHAFAAYLALKGQRVLAWDIDAQRIKEIQDRGAIIAEGPGLAGTAHPDLLTSDIGLAVKDADVILIVVPAIHHASIAAKIASYISEGQLIILNPGRTGGALEFRKILRENGAPEVTIGETSNMLFTCRSERPGQVTVNAITRAMDFACLPAAKAGWALEQIGSVLPQYQAVENVLHTSLTNIEAVLHPLPTLLNAARCESGTPFHYYTEGITPSVGALAEKVDAERIAIAKAFDLNVPSVCEWVKISYGQSPATIYEAVQGNPVLRGIMGPTSLNTVHFFEDVSTGLVPLSELGRAVNVPTPLIDAVLLLISSLIDVDFRKEGRTLEKLGLSGLTAAEIRSAVE

SEQ ID NO: 599 - DNA, 1077 bp, Artificial Sequence
  Engineered variant of opine dehydrogenase CENDH
atgatcgagtcaaaaacatacgccgttttgggattaggaaacgggggtcacgcatttgccgcctatttagcattgaagggccagcgtgtactggcttgggacatcgatgctcagagaatcaaagagattcaggaccgtggagccatcatagcggaaggaccaggacttgctgggactgctcacccggatcttctgacctcagatataggtttggcggttaaagacgctgatgtgatactgattgtagtgccggccatccaccacgcttccattgcagcaaaaatcgccagttacatttccgagggtcagttgattatccttaaccctggggcaacgggtggagcgctggaattccggaaaatcctgcgtgaaaatggtgcgccggaggtaacgatcggggaaacctcaagtatgctctttacatgccgctccgagagaccaggacaggttacggtaaatgcgataacacgtgccatggactttgcatgtctcccagcggcaaaagctggatgggccctggaacagatagggtcggttcttcctcaataccaggctgtcgaaaacgtgttgcatacttcgctgactaatatcgaagctgtattgcacccgctgccaacactgttaaacgctgctcgttgtgagtctggtaccccattccattattataccgaggggattacgccatcagtcggggcgcttgcggagaaagtggacgctgaacgcatagcaatcgcaaaggctttcgatttaaacgttccgtcggtctgcgaatgggttaagattagttacggccagtcaccggccacaatttatgaagcggtgcagggtaatcctgctctgcgcggcattatgggacctaccagccttaacacggtgcacttcttctgggatgtaagcaccggactggtaccgttatccgaactgggtcgggcagtgaatgtgcctaccccacttatcgatgctgttcttctgttgatcagttcgctgatagacgtggatttcagaaaggaaggtcgtaccttggaaaaattaggtctgagcggacttaccgccgcggaaataagaagtgctgttgag

SEQ ID NO: 600 - protein, 359 aa, Artificial Sequence
  Engineered variant of opine dehydrogenase CENDH
MIESKTYAVLGLGNGGHAFAAYLALKGQRVLAWDIDAQRIKEIQDRGAIIAEGPGLAGTAHPDLLTSDIGLAVKDADVILIVVPAIHHASIAAKIASYISEGQLIILNPGATGGALEFRKILRENGAPEVTIGETSSMLFTCRSERPGQVTVNAITRAMDFACLPAAKAGWALEQIGSVLPQYQAVENVLHTSLTNIEAVLHPLPTLLNAARCESGTPFHYYTEGITPSVGALAEKVDAERIAIAKAFDLNVPSVCEWVKISYGQSPATIYEAVQGNPALRGIMGPTSLNTVHFFWDVSTGLVPLSELGRAVNVPTPLIDAVLLLISSLIDVDFRKEGRTLEKLGLSGLTAAEIRSAVE

SEQ ID NO: 601 - DNA, 1077 bp, Artificial Sequence
  Engineered variant of opine dehydrogenase CENDH
atgatcgagtcaaaaacatacgccgttttgggattaggaaacgggggtcacgcatttgccgcctatttagcattgaagggccagcgtgtactggcttgggacatcgatgctcagagaatcaaagagattcaggaccgtggagccatcatagcggaaggaccaggacttgctgggactgctcacccggatcttctgacctcagatataggtttggcggttaaagacgctgatgtgatactgattgtagtgccggccatccaccacgcttccattgcagcaaaaatcgccagttacatttccgagggtcagttgattatccttaaccctggggcaacgggtggagcgctggaattccggaaaatcctgcgtgaaaatggtgcgccggaggtaacgatcggggaaacctcaagtatgctctttacatgccgctccgagagaccaggacaggttacggtaaatgcgataacacgtgccatggactttgcatgtctcccagcggcaaaagctggatgggccctggaacagatagggtcggttcttcctcaataccaggctgtcgaaaacgtgttgcatacttcgctgactaatatcgaagctgtattgcacccgctgccaacactgttaaacgctgctcgttgtgagtctggtaccccattccattattataccgaggggattacgccatcagtcggggcgcttgcggagaaagtggacgctgaacgcatagcaatcgcaaaggctttcgatttaaacgttccgtcggtctgcgaatgggttaagattagttacggccagtcaccggccacaatttatgaagcggtgcagggtaatcctgtgctgcgcggcattatgggacctaccagccttaacacggtgcacttcttcgaggatgtaagcaccggactggtaccgttatccgaactgggtcgggcagtgaatgtgcctaccccacttatcgatgctgttcttctgttgatcagttcgctgatagacgtggatttcagaaaggaaggtcgtaccttggaaaaattaggtctgagcggacttaccgccgcggaaataagaagtgctgttgag

SEQ ID NO: 602 - protein, 359 aa, Artificial Sequence
  Engineered variant of opine dehydrogenase CENDH
MIESKTYAVLGLGNGGHAFAAYLALKGQRVLAWDIDAQRIKEIQDRGAIIAEGPGLAGTAHPDLLTSDIGLAVKDADVILIVVPAIHHASIAAKIASYISEGQLIILNPGATGGALEFRKILRENGAPEVTIGETSSMLFTCRSERPGQVTVNAITRAMDFACLPAAKAGWALEQIGSVLPQYQAVENVLHTSLTNIEAVLHPLPTLLNAARCESGTPFHYYTEGITPSVGALAEKVDAERIAIAKAFDLNVPSVCEWVKISYGQSPATIYEAVQGNPVLRGIMGPTSLNTVHFFEDVSTGLVPLSELGRAVNVPTPLIDAVLLLISSLIDVDFRKEGRTLEKLGLSGLTAAEIRSAVE

SEQ ID NO: 603 - DNA, 1077 bp, Artificial Sequence
  Engineered variant of opine dehydrogenase CENDH
atgatcgagtcaaaaacatacgccgttttgggattaggaaacgggggtcacgcatttgccgcctatttagcattgaagggccagcgtgtactggcttgggacatcgatgctcagagaatcaaagagattcaggaccgtggagccatcatagcggaaggaccaggacttgctgggactgctcacccggatcttctgacctcagatataggtttggcggttaaagacgctgatgtgatactgattgtagtgccggccatccaccacgcttccattgcagcacgtatcgccagttacatttccgagggtcagttgattatccttaaccctggggcaacgggtggagcgctggaattccggaaaatcctgcgtgaaaatggtgcgccggaggtaacgatcggggaaacctcaaacatgctctttacatgccgctccgagagaccaggacaggttacggtaaatgcgataacacgtgccatggactttgcatgtctcccagcggcaaaagctggatgggccctggaacagatagggtcggttcttcctcaataccaggctgtcgaaaacgtgttgcatacttcgctgactaatatcgaagctgtattgcacccgctgccaacactgttaaacgctgctcgttgtgagtctggtaccccattccattattataccgaggggattacgccatcagtcggggcgcttgcggagaaagtggacgctgaacgcatagcaatcgcaaaggctttcgatttaaacgttccgtcggtctgcgaatgggttaagattagttacggccagtcaccggccacaatttatgaagcggtgcagggtaatccttttctgcgcggcattatgggacctaccagccttaacacggtgcacttcttcgaggatgtaagcaccggactggtaccgttatccgaactgggtcgggcagtgaatgtgcctaccccacttatcgatgctgttcttctgttgatcagttcgctgatagacgtggatttcagaaaggaaggtcgtaccttggaaaaattaggtctgagcggacttaccgccgcggaaataagaagtgctgttgag

SEQ ID NO: 604 - protein, 359 aa, Artificial Sequence
  Engineered variant of opine dehydrogenase CENDH
MIESKTYAVLGLGNGGHAFAAYLALKGQRVLAWDIDAQRIKEIQDRGAIIAEGPGLAGTAHPDLLTSDIGLAVKDADVILIVVPAIHHASIAARIASYISEGQLIILNPGATGGALEFRKILRENGAPEVTIGETSNMLFTCRSERPGQVTVNAITRAMDFACLPAAKAGWALEQIGSVLPQYQAVENVLHTSLTNIEAVLHPLPTLLNAARCESGTPFHYYTEGITPSVGALAEKVDAERIAIAKAFDLNVPSVCEWVKISYGQSPATIYEAVQGNPFLRGIMGPTSLNTVHFFEDVSTGLVPLSELGRAVNVPTPLIDAVLLLISSLIDVDFRKEGRTLEKLGLSGLTAAEIRSAVE

SEQ ID NO: 605 - DNA, 1077 bp, Artificial Sequence
  Engineered variant of opine dehydrogenase CENDH
atgatcgagtcaaaaacatacgccgttttgggattaggaaacgggggtcacgcatttgccgcctatttagcattgaagggccagcgtgtactggcttgggacatcgatgctcagagaatcaaagagattcaggaccgtggagccatcatagcggaaggaccaggacttgctgggactgctcacccggatcttctgacctcagatataggtttggcggttaaagacgctgatgtgatactgattgtagtgccggccatccaccacgcttccattgcagcaaatatcgccagttacatttccgagggtcagttgattatccttaaccctggggcaacgggtggagcgctggaattccggaaaatcctgcgtgaaaatggtgcgccggaggtaacgatcggggaaacctcaagtatgctctttacatgccgctccgagagaccaggacaggttacggtaaatgcgataacacgtgccatggactttgcatgtctcccagcggcaaaagctggatgggccctggaacagatagggtcggttcttcctcaataccaggctgtcgaaaacgtgttgcatacttcgctgactaatatcgaagctgtattgcacccgctgccaacactgttaaacgctgctcgttgtgagtctggtaccccattccattattataccgaggggattacgccatcagtcggggcgcttgcggagaaagtggacgctgaacgcatagcaatcgcaaaggctttcgatttaaacgttccgtcggtctgcgaatgggttaagattagttacggccagtcaccggccacaatttatgaagcggtgcagggtaatcctgctctgcgcggcattatgggacctaccagccttaacacggtgcacttcttctgggatgtaagcaccggactggtaccgttatccgaactgggtcgggcagtgaatgtgcctaccccacttatcgatgctgttcttctgttgatcagttcgctgatagacgtggatttcagaaaggaaggtcgtaccttggaaaaattaggtctgagcggacttaccgccgcggaaataagaagtgctgttgag

SEQ ID NO: 606 - protein, 359 aa, Artificial Sequence
  Engineered variant of opine dehydrogenase CENDH
MIESKTYAVLGLGNGGHAFAAYLALKGQRVLAWDIDAQRIKEIQDRGAIIAEGPGLAGTAHPDLLTSDIGLAVKDADVILIVVPAIHHASIAANIASYISEGQLIILNPGATGGALEFRKILRENGAPEVTIGETSSMLFTCRSERPGQVTVNAITRAMDFACLPAAKAGWALEQIGSVLPQYQAVENVLHTSLTNIEAVLHPLPTLLNAARCESGTPFHYYTEGITPSVGALAEKVDAERIAIAKAFDLNVPSVCEWVKISYGQSPATIYEAVQGNPALRGIMGPTSLNTVHFFWDVSTGLVPLSELGRAVNVPTPLIDAVLLLISSLIDVDFRKEGRTLEKLGLSGLTAAEIRSAVE

SEQ ID NO: 607 - DNA, 1077 bp, Artificial Sequence
  Engineered variant of opine dehydrogenase CENDH
atgatcgagtcaaaaacatacgccgttttgggattaggaaacgggggtcacgcatttgccgcctatttagcattgaagggccagcgtgtactggcttgggacatcgatgctcagagaatcaaagagattcaggaccgtggagccatcatagcggaaggaccaggacttgctgggactgctcacccggatcttctgacctcagatataggtttggcggttaaagacgctgatgtgatactgattgtagtgccggccatccaccacgcttccattgcagcacgtatcgccagttacatttccgagggtcagttgattatccttaaccctgggcgtacgggtggagcgctggaattccggaaaatcctgcgtgaaaatggtgcgccggaggtaacgatcggggaaacctcaaacatgctctttacatgccgctccgagagaccaggacaggttacggtaaatgcgataacacgtgccatggactttgcatgtctcccagcggcaaaagctggatgggccctggaacagatagggtcggttcttcctcaataccaggctgtcgaaaacgtgttgcatacttcgctgactaatatcgaagctgtattgcacccgctgccaacactgttaaacgctgctcgttgtgagtctggtaccccattccattattataccgaggggattacgccatcagtcggggcgcttgcggagaaagtggacgctgaacgcatagcaatcgcaaaggctttcgatttaaacgttccgtcggtctgcgaatgggttaagattagttacggccagtcaccggccacaatttatgaagcggtgcagggtaatccttttctgcgcggcattatgggacctaccagccttaacacggtgcacttcttcgaggatgtaagcaccggactggtaccgttatccgaactgggtcgggcagtgaatgtgcctaccccacttatcgatgctgttcttctgttgatcagttcgctgatagacgtggatttcagaaaggaaggtcgtaccttggaaaaattaggtctgagcggacttaccgccgcggaaataagaagtgctgttgag

SEQ ID NO: 608 - protein, 359 aa, Artificial Sequence
  Engineered variant of opine dehydrogenase CENDH
MIESKTYAVLGLGNGGHAFAAYLALKGQRVLAWDIDAQRIKEIQDRGAIIAEGPGLAGTAHPDLLTSDIGLAVKDADVILIVVPAIHHASIAARIASYISEGQLIILNPGRTGGALEFRKILRENGAPEVTIGETSNMLFTCRSERPGQVTVNAITRAMDFACLPAAKAGWALEQIGSVLPQYQAVENVLHTSLTNIEAVLHPLPTLLNAARCESGTPFHYYTEGITPSVGALAEKVDAERIAIAKAFDLNVPSVCEWVKISYGQSPATIYEAVQGNPFLRGIMGPTSLNTVHFFEDVSTGLVPLSELGRAVNVPTPLIDAVLLLISSLIDVDFRKEGRTLEKLGLSGLTAAEIRSAVE

SEQ ID NO: 609 - DNA, 1077 bp, Artificial Sequence
  Engineered variant of opine dehydrogenase CENDH
atgatcgagtcaaaaacatacgccgttttgggattaggaaacgggggtcacgcatttgccgcctatttagcattgaagggccagcgtgtactggcttgggacatcgatgctcagagaatcaaagagattcaggaccgtggagccatcatagcggaaggaccaggacttgctgggactgctcacccggatcttctgacctcagatataggtttggcggttaaagacgctgatgtgatactgattgtagtgccggccatccaccacgcttccattgcagcaaatatcgccagttacatttccgagggtcagttgattatccttaaccctggggcaacgggtggagcgctggaattccggaaaatcctgcgtgaaaatggtgcgccggaggtaacgatcggggaaacctcaagtatgctctttacatgccgctccgagagaccaggacaggttacggtaaattatataacacgtgccatggactttgcatgtctcccagcggcaaaagctggatgggccctggaacagatagggtcggttcttcctcaataccaggctgtcgaaaacgtgttgcatacttcgctgactaatatcgaagctgtattgcacccgctgccaacactgttaaacgctgctcgttgtgagtctggtaccccattccattattataccgaggggattacgccatcagtcggggcgcttgcggagaaagtggacgctgaacgcatagcaatcgcaaaggctttcgatttaaacgttccgtcggtctgcgaatgggttaagattagttacggccagtcaccggccacaatttatgaagcggtgcagggtaatccttttctgcgcggcattatgggacctaccagccttaacacggtgcacttcttctgggatgtaagcaccggactggtaccgttatccgaactgggtcgggcagtgaatgtgcctaccccacttatcgatgctgttcttctgttgatcagttcgctgatagacgtggatttcagaaaggaaggtcgtaccttggaaaaattaggtctgagcggacttaccgccgcggaaataagaagtgctgttgag

SEQ ID NO: 610 - protein, 359 aa, Artificial Sequence
  Engineered variant of opine dehydrogenase CENDH
MIESKTYAVLGLGNGGHAFAAYLALKGQRVLAWDIDAQRIKEIQDRGAIIAEGPGLAGTAHPDLLTSDIGLAVKDADVILIVVPAIHHASIAANIASYISEGQLIILNPGATGGALEFRKILRENGAPEVTIGETSSMLFTCRSERPGQVTVNYITRAMDFACLPAAKAGWALEQIGSVLPQYQAVENVLHTSLTNIEAVLHPLPTLLNAARCESGTPFHYYTEGITPSVGALAEKVDAERIAIAKAFDLNVPSVCEWVKISYGQSPATIYEAVQGNPFLRGIMGPTSLNTVHFFWDVSTGLVPLSELGRAVNVPTPLIDAVLLLISSLIDVDFRKEGRTLEKLGLSGLTAAEIRSAVE

SEQ ID NO: 611 - DNA, 1077 bp, Artificial Sequence
  Engineered variant of opine dehydrogenase CENDH
atgatcgagtcaaaaacatacgccgttttgggattaggaaacgggggtcacgcatttgccgcctatttagcattgaagggccagcgtgtactggcttgggacatcgatgctcagagaatcaaagagattcaggaccgtggagccatcatagcggaaggaccaggacttgctgggactgctcacccggatcttctgacctcagatataggtttggcggttaaagacgctgatgtgatactgattgtagtgccggccatccaccacgcttccattgcagcaaatatcgccagttacatttccgagggtcagttgattatccttaaccctggggcaacgggtggagcgctggaattccggaaaatcctgcgtgaaaatggtgcgccggaggtaacgatcggggaaacctcaagtatgctctttacatgccgctccgagagaccaggacaggttacggtaaatgcgataacacgtgccatggactttgcatgtctcccagcggcaaaagctggatgggccctggaacagatagggtcggttcttcctcaataccaggctgtcgaaaacgtgttgcatacttcgctgactaatatcgaagctgtattgcacccgctgccaacactgttaaacgctgctcgttgtgagtctggtaccccattccattattataccgaggggattacgccatcagtcggggcgcttgcggagaaagtggacgctgaacgcatagcaatcgcaaaggctttcgatttaaacgttccgtcggtctgcgaatgggttaagattagttacggccagtcaccggccacaatttatgaagcggtgcagggtaatccttttctgcgcggcattatgggacctaccagccttaacacggtgcacttcttctgggatgtaagcaccggactggtaccgttatccgaactgggtcgggcagtgaatgtgcctaccccacttatcgatgctgttcttctgttgatcagttcgctgatagacgtggatttcagaaaggaaggtcgtaccttggaaaaattaggtctgagcggacttaccgccgcggaaataagaagtgctgttgag

SEQ ID NO: 612 - protein, 359 aa, Artificial Sequence
  Engineered variant of opine dehydrogenase CENDH
MIESKTYAVLGLGNGGHAFAAYLALKGQRVLAWDIDAQRIKEIQDRGAIIAEGPGLAGTAHPDLLTSDIGLAVKDADVILIVVPAIHHASIAANIASYISEGQLIILNPGATGGALEFRKILRENGAPEVTIGETSSMLFTCRSERPGQVTVNAITRAMDFACLPAAKAGWALEQIGSVLPQYQAVENVLHTSLTNIEAVLHPLPTLLNAARCESGTPFHYYTEGITPSVGALAEKVDAERIAIAKAFDLNVPSVCEWVKISYGQSPATIYEAVQGNPFLRGIMGPTSLNTVHFFWDVSTGLVPLSELGRAVNVPTPLIDAVLLLISSLIDVDFRKEGRTLEKLGLSGLTAAEIRSAVE

SEQ ID NO: 613 - DNA, 1077 bp, Artificial Sequence
  Engineered variant of opine dehydrogenase CENDH
atgatcgagtcaaaaacatacgccgttttgggattaggaaacgggggtcacgcatttgccgcctatttagcattgaagggccagcgtgtactggcttgggacatcgatgctcagagaatcaaagagattcaggaccgtggagccatcatagcggaaggaccaggacttgctgggactgctcacccggatcttctgacctcagatataggtttggcggttaaagacgctgatgtgatactgattgtagtgccggccatccaccacgcttccattgcagcaaaaatcgccagttacatttccgagggtcagttgattatccttaaccctggggcaacgggtggagcgctggaattccggaaaatcctgcgtgaaaatggtgcgccggaggtaacgatcggggaaacctcaaacatgctctttacatgccgctccgagagaccaggacaggttacggtaaatgcgataacacgtgccatggactttgcatgtctcccagcggcaaaagctggatgggccctggaacagatagggtcggttcttcctcaataccaggctgtcgaaaacgtgttgcatacttcgctgactaatatcgaagctgtattgcacccgctgccaacactgttaaacgctgctcgttgtgagtctggtaccccattccattattataccgaggggattacgccatcagtcggggcgcttgcggagaaagtggacgctgaacgcatagcaatcgcaaaggctttcgatttaaacgttccgtcggtctgcgaatgggttaagattagttacggccagtcaccggccacaatttatgaagcggtgcagggtaatcctgtgctgcgcggcattatgggacctaccagccttaacacggtgcacttcttctgggatgtaagcaccggactggtaccgttatccgaactgggtcgggcagtgaatgtgcctaccccacttatcgatgctgttcttctgttgatcagttcgctgatagacgtggatttcagaaaggaaggtcgtaccttggaaaaattaggtctgagcggacttaccgccgcggaaataagaagtgctgttgag

SEQ ID NO: 614 - protein, 359 aa, Artificial Sequence
  Engineered variant of opine dehydrogenase CENDH
MIESKTYAVLGLGNGGHAFAAYLALKGQRVLAWDIDAQRIKEIQDRGAIIAEGPGLAGTAHPDLLTSDIGLAVKDADVILIVVPAIHHASIAAKIASYISEGQLIILNPGATGGALEFRKILRENGAPEVTIGETSNMLFTCRSERPGQVTVNAITRAMDFACLPAAKAGWALEQIGSVLPQYQAVENVLHTSLTNIEAVLHPLPTLLNAARCESGTPFHYYTEGITPSVGALAEKVDAERIAIAKAFDLNVPSVCEWVKISYGQSPATIYEAVQGNPVLRGIMGPTSLNTVHFFWDVSTGLVPLSELGRAVNVPTPLIDAVLLLISSLIDVDFRKEGRTLEKLGLSGLTAAEIRSAVE

SEQ ID NO: 615 - DNA, 1077 bp, Artificial Sequence
  Engineered variant of opine dehydrogenase CENDH
atgatcgagtcaaaaacatacgccgttttgggattaggaaacgggggtcacgcatttgccgcctatttagcattgaagggccagcgtgtactggcttgggacatcgatgctcagagaatcaaagagattcaggaccgtggagccatcatagcggaaggaccaggacttgctgggactgctcacccggatcttctgacctcagatataggtttggcggttaaagacgctgatgtgatactgattgtagtgccggccatccaccacgcttccattgcagcacgtatcgccagttacatttccgagggtcagttgattatccttaaccctggggcaacgggtggagcgctggaattccggaaaatcctgcgtgaaaatggtgcgccggaggtaacgatcggggaaacctcaagtatgctctttacatgccgctccgagagaccaggacaggttacggtaaatgcgataacacgtgccatggactttgcatgtctcccagcggcaaaagctggatgggccctggaacagatagggtcggttcttcctcaataccaggctgtcgaaaacgtgttgcatacttcgctgactaatatcgaagctgtattgcacccgctgccaacactgttaaacgctgctcgttgtgagtctggtaccccattccattattataccgaggggattacgccatcagtcggggcgcttgcggagaaagtggacgctgaacgcatagcaatcgcaaaggctttcgatttaaacgttccgtcggtctgcgaatgggttaagattagttacggccagtcaccggccacaatttatgaagcggtgcagggtaatccttttctgcgcggcattatgggacctaccagccttaacacggtgcacttcttctgggatgtaagcaccggactggtaccgttatccgaactgggtcgggcagtgaatgtgcctaccccacttatcgatgctgttcttctgttgatcagttcgctgatagacgtggatttcagaaaggaaggtcgtaccttggaaaaattaggtctgagcggacttaccgccgcggaaataagaagtgctgttgag

SEQ ID NO: 616 - protein, 359 aa, Artificial Sequence
  Engineered variant of opine dehydrogenase CENDH
MIESKTYAVLGLGNGGHAFAAYLALKGQRVLAWDIDAQRIKEIQDRGAIIAEGPGLAGTAHPDLLTSDIGLAVKDADVILIVVPAIHHASIAARIASYISEGQLIILNPGATGGALEFRKILRENGAPEVTIGETSSMLFTCRSERPGQVTVNAITRAMDFACLPAAKAGWALEQIGSVLPQYQAVENVLHTSLTNIEAVLHPLPTLLNAARCESGTPFHYYTEGITPSVGALAEKVDAERIAIAKAFDLNVPSVCEWVKISYGQSPATIYEAVQGNPFLRGIMGPTSLNTVHFFWDVSTGLVPLSELGRAVNVPTPLIDAVLLLISSLIDVDFRKEGRTLEKLGLSGLTAAEIRSAVE

SEQ ID NO: 617 - DNA, 1077 bp, Artificial Sequence
  Engineered variant of opine dehydrogenase CENDH
atgatcgagtcaaaaacatacgccgttttgggattaggaaacgggggtcacgcatttgccgcctatttagcattgaagggccagcgtgtactggcttgggacatcgatgctcagagaatcaaagagattcaggaccgtggagccatcatagcggaaggaccaggacttgctgggactgctcacccggatcttctgacctcagatataggtttggcggttaaagacgctgatgtgatactgattgtagtgccggccatccaccacgcttccattgcagcaaaaatcgccagttacatttccgagggtcagttgattatccttaaccctgggcgtacgggtggagcgctggaattccggaaaatcctgcgtgaaaatggtgcgccggaggtaacgatcggggaaacctcaaacatgctctttacatgccgctccgagagaccaggacaggttacggtaaattatataacacgtgccatggactttgcatgtctcccagcggcaaaagctggatgggccctggaacagatagggtcggttcttcctcaataccaggctgtcgaaaacgtgttgcatacttcgctgactaatatcgaagctgtattgcacccgctgccaacactgttaaacgctgctcgttgtgagtctggtaccccattccattattataccgaggggattacgccatcagtcggggcgcttgcggagaaagtggacgctgaacgcatagcaatcgcaaaggctttcgatttaaacgttccgtcggtctgcgaatgggttaagattagttacggccagtcaccggccacaatttatgaagcggtgcagggtaatcctgtgctgcgcggcattatgggacctaccagccttaacacggtgcacttcttcgaggatgtaagcaccggactggtaccgttatccgaactgggtcgggcagtgaatgtgcctaccccacttatcgatgctgttcttctgttgatcagttcgctgatagacgtggatttcagaaaggaaggtcgtaccttggaaaaattaggtctgagcggacttaccgccgcggaaataagaagtgctgttgag

SEQ ID NO: 618 - protein, 359 aa, Artificial Sequence
  Engineered variant of opine dehydrogenase CENDH
MIESKTYAVLGLGNGGHAFAAYLALKGQRVLAWDIDAQRIKEIQDRGAIIAEGPGLAGTAHPDLLTSDIGLAVKDADVILIVVPAIHHASIAAKIASYISEGQLIILNPGRTGGALEFRKILRENGAPEVTIGETSNMLFTCRSERPGQVTVNYITRAMDFACLPAAKAGWALEQIGSVLPQYQAVENVLHTSLTNIEAVLHPLPTLLNAARCESGTPFHYYTEGITPSVGALAEKVDAERIAIAKAFDLNVPSVCEWVKISYGQSPATIYEAVQGNPVLRGIMGPTSLNTVHFFEDVSTGLVPLSELGRAVNVPTPLIDAVLLLISSLIDVDFRKEGRTLEKLGLSGLTAAEIRSAVE

SEQ ID NO: 619 - DNA, 1077 bp, Artificial Sequence
  Engineered variant of opine dehydrogenase CENDH
atgatcgagtcaaaaacatacgccgttttgggattaggaaacgggggtcacgcatttgccgcctatttagcattgaagggccagcgtgtactggcttgggacatcgatgctcagagaatcaaagagattcaggaccgtggagccatcatagcggaaggaccaggacttgctgggactgctcacccggatcttctgacctcagatataggtttggcggttaaagacgctgatgtgatactgattgtagtgccggccatccaccacgcttccattgcagcacgtatcgccagttacatttccgagggtcagttgattatccttaaccctggggcaacgggtggagcgctggaattccggaaaatcctgcgtgaaaatggtgcgccggaggtaacgatcggggaaacctcaagtatgctctttacatgccgctccgagagaccaggacaggttacggtaaatgcgataacacgtgccatggactttgcatgtctcccagcggcaaaagctggatgggccctggaacagatagggtcggttcttcctcaataccaggctgtcgaaaacgtgttgcatacttcgctgactaatatcgaagctgtattgcacccgctgccaacactgttaaacgctgctcgttgtgagtctggtaccccattccattattataccgaggggattacgccatcagtcggggcgcttgcggagaaagtggacgctgaacgcatagcaatcgcaaaggctttcgatttaaacgttccgtcggtctgcgaatgggttaagattagttacggccagtcaccggccacaatttatgaagcggtgcagggtaatcctgctctgcgcggcattatgggacctaccagccttaacacggtgcacttcttcgaggatgtaagcaccggactggtaccgttatccgaactgggtcgggcagtgaatgtgcctaccccacttatcgatgctgttcttctgttgatcagttcgctgatagacgtggatttcagaaaggaaggtcgtaccttggaaaaattaggtctgagcggacttaccgccgcggaaataagaagtgctgttgag

SEQ ID NO: 620 - protein, 359 aa, Artificial Sequence
  Engineered variant of opine dehydrogenase CENDH
MIESKTYAVLGLGNGGHAFAAYLALKGQRVLAWDIDAQRIKEIQDRGAIIAEGPGLAGTAHPDLLTSDIGLAVKDADVILIVVPAIHHASIAARIASYISEGQLIILNPGATGGALEFRKILRENGAPEVTIGETSSMLFTCRSERPGQVTVNAITRAMDFACLPAAKAGWALEQIGSVLPQYQAVENVLHTSLTNIEAVLHPLPTLLNAARCESGTPFHYYTEGITPSVGALAEKVDAERIAIAKAFDLNVPSVCEWVKISYGQSPATIYEAVQGNPALRGIMGPTSLNTVHFFEDVSTGLVPLSELGRAVNVPTPLIDAVLLLISSLIDVDFRKEGRTLEKLGLSGLTAAEIRSAVE

SEQ ID NO: 621 - DNA, 1077 bp, Artificial Sequence
  Engineered variant of opine dehydrogenase CENDH
atgatcgagtcaaaaacatacgccgttttgggattaggaaacgggggtcacgcatttgccgcctatttagcattgaagggccagcgtgtactggcttgggacatcgatgctcagagaatcaaagagattcaggaccgtggagccatcatagcggaaggaccaggacttgctgggactgctcacccggatcttctgacctcagatataggtttggcggttaaagacgctgatgtgatactgattgtagtgccggccatccaccacgcttccattgcagcacgtatcgccagttacatttccgagggtcagttgattatccttaaccctggggcaacgggtggagcgctggaattccggaaaatcctgcgtgaaaatggtgcgccggaggtaacgatcggggaaacctcaagtatgctctttacatgccgctccgagagaccaggacaggttacggtaaatgcgataacacgtgccatggactttgcatgtctcccagcggcaaaagctggatgggccctggaacagatagggtcggttcttcctcaataccaggctgtcgaaaacgtgttgcatacttcgctgactaatatcgaagctgtattgcacccgctgccaacactgttaaacgctgctcgttgtgagtctggtaccccattccattattataccgaggggattacgccatcagtcggggcgcttgcggagaaagtggacgctgaacgcatagcaatcgcaaaggctttcgatttaaacgttccgtcggtctgcgaatgggttaagattagttacggccagtcaccggccacaatttatgaagcggtgcagggtaatcctgtgctgcgcggcattatgggacctaccagccttaacacggtgcacttcttctgggatgtaagcaccggactggtaccgttatccgaactgggtcgggcagtgaatgtgcctaccccacttatcgatgctgttcttctgttgatcagttcgctgatagacgtggatttcagaaaggaaggtcgtaccttggaaaaattaggtctgagcggacttaccgccgcggaaataagaagtgctgttgag

SEQ ID NO: 622 - protein, 359 aa, Artificial Sequence
  Engineered variant of opine dehydrogenase CENDH
MIESKTYAVLGLGNGGHAFAAYLALKGQRVLAWDIDAQRIKEIQDRGAIIAEGPGLAGTAHPDLLTSDIGLAVKDADVILIVVPAIHHASIAARIASYISEGQLIILNPGATGGALEFRKILRENGAPEVTIGETSSMLFTCRSERPGQVTVNAITRAMDFACLPAAKAGWALEQIGSVLPQYQAVENVLHTSLTNIEAVLHPLPTLLNAARCESGTPFHYYTEGITPSVGALAEKVDAERIAIAKAFDLNVPSVCEWVKISYGQSPATIYEAVQGNPVLRGIMGPTSLNTVHFFWDVSTGLVPLSELGRAVNVPTPLIDAVLLLISSLIDVDFRKEGRTLEKLGLSGLTAAEIRSAVE

SEQ ID NO: 623 - DNA, 1077 bp, Artificial Sequence
  Engineered variant of opine dehydrogenase CENDH
atgatcgagtcaaaaacatacgccgttttgggattaggaaacgggggtcacgcatttgccgcctatttagcattgaagggccagcgtgtactggcttgggacatcgatgctcagagaatcaaagagattcaggaccgtggagccatcatagcggaaggaccaggacttgctgggactgctcacccggatcttctgacctcagatataggtttggcggttaaagacgctgatgtgatactgattgtagtgccggccatccaccacgcttccattgcagcaaatatcgccagttacatttccgagggtcagttgattatccttaaccctggggcaacgggtggagcgctggaattccggaaaatcctgcgtgaaaatggtgcgccggaggtaacgatcggggaaacctcaagtatgctctttacatgccgctccgagagaccaggacaggttacggtaaatgcgataacacgtgccatggactttgcatgtctcccagcggcaaaagctggatgggccctggaacagatagggtcggttcttcctcaataccaggctgtcgaaaacgtgttgcatacttcgctgactaatatcgaagctgtattgcacccgctgccaacactgttaaacgctgctcgttgtgagtctggtaccccattccattattataccgaggggattacgccatcagtcggggcgcttgcggagaaagtggacgctgaacgcatagcaatcgcaaaggctttcgatttaaacgttccgtcggtctgcgaatgggttaagattagttacggccagtcaccggccacaatttatgaagcggtgcagggtaatcctgtgctgcgcggcattatgggacctaccagccttaacacggtgcacttcttctgggatgtaagcaccggactggtaccgttatccgaactgggtcgggcagtgaatgtgcctaccccacttatcgatgctgttcttctgttgatcagttcgctgatagacgtggatttcagaaaggaaggtcgtaccttggaaaaattaggtctgagcggacttaccgccgcggaaataagaagtgctgttgag

SEQ ID NO: 624 - protein, 359 aa, Artificial Sequence
  Engineered variant of opine dehydrogenase CENDH
MIESKTYAVLGLGNGGHAFAAYLALKGQRVLAWDIDAQRIKEIQDRGAIIAEGPGLAGTAHPDLLTSDIGLAVKDADVILIVVPAIHHASIAANIASYISEGQLIILNPGATGGALEFRKILRENGAPEVTIGETSSMLFTCRSERPGQVTVNAITRAMDFACLPAAKAGWALEQIGSVLPQYQAVENVLHTSLTNIEAVLHPLPTLLNAARCESGTPFHYYTEGITPSVGALAEKVDAERIAIAKAFDLNVPSVCEWVKISYGQSPATIYEAVQGNPVLRGIMGPTSLNTVHFFWDVSTGLVPLSELGRAVNVPTPLIDAVLLLISSLIDVDFRKEGRTLEKLGLSGLTAAEIRSAVE

SEQ ID NO: 625 - DNA, 1077 bp, Artificial Sequence
  Engineered variant of opine dehydrogenase CENDH
atgatcgagtcaaaaacatacgccgttttgggattaggaaacgggggtcacgcatttgccgcctatttagcattgaagggccagcgtgtactggcttgggacatcgatgctcagagaatcaaagagattcaggaccgtggagccatcatagcggaaggaccaggacttgctgggactgctcacccggatcttctgacctcagatataggtttggcggttaaagacgctgatgtgatactgattgtagtgccggccatccaccacgcttccattgcagcacgtatcgccagttacatttccgagggtcagttgattatccttaaccctgggcgtacgggtggagcgctggaattccggaaaatcctgcgtgaaaatggtgcgccggaggtaacgatcggggaaacctcaaacatgctctttacatgccgctccgagagaccaggacaggttacggtaaatgcgataacacgtgccatggactttgcatgtctcccagcggcaaaagctggatgggccctggaacagatacattcggttcttcctcaataccaggctgtcgaaaacgtgttgcatacttcgctgactaatatcgaagctgtattgcacccgctgccaacactgttaaacgctgctcgttgtgagtctggtaccccattccattattataccgaggggattacgccatcagtcggggcgcttgcggagaaagtggacgctgaacgcatagcaatcgcaaaggctttcgatttaaacgttccgtcggtctgcgaatgggttaagattagttacggcctgtcaccggccacaatttatgaagcggtgcagggtaatcctgtgctgcgcggcattatgggacctaccagccttaacacggtgcacttcttcgaggatgtaagcaccggactggtaccgttatccgaactgggtcggaccgtgaatgtgcctaccccacttatcgatgctgttcttctgttgatcagttcgctgatagacgtggatttcagaaaggaaggtcgtaccttggaaaaattaggtctgagcggacttaccgccgcggaaataagaagtgctgttgag

SEQ ID NO: 626 - protein, 359 aa, Artificial Sequence
  Engineered variant of opine dehydrogenase CENDH
MIESKTYAVLGLGNGGHAFAAYLALKGQRVLAWDIDAQRIKEIQDRGAIIAEGPGLAGTAHPDLLTSDIGLAVKDADVILIVVPAIHHASIAARIASYISEGQLIILNPGRTGGALEFRKILRENGAPEVTIGETSNMLFTCRSERPGQVTVNAITRAMDFACLPAAKAGWALEQIHSVLPQYQAVENVLHTSLTNIEAVLHPLPTLLNAARCESGTPFHYYTEGITPSVGALAEKVDAERIAIAKAFDLNVPSVCEWVKISYGLSPATIYEAVQGNPVLRGIMGPTSLNTVHFFEDVSTGLVPLSELGRTVNVPTPLIDAVLLLISSLIDVDFRKEGRTLEKLGLSGLTAAEIRSAVE

SEQ ID NO: 627 - DNA, 1077 bp, Artificial Sequence
  Engineered variant of opine dehydrogenase CENDH
atgatcgagtcaaaaacatacgccgttttgggattaggaaacgggggtcacgcatttgccgcctatttagcattgaagggccagcgtgtactggcttgggacatcgatgctcagagaatcaaagagattcaggaccgtggagccatcatagcggaaggaccaggacttgctgggactgctcacccggatcttctgacctcagatataggtttggcggttaaagacgctgatgtgatactgattgtagtgccggccatccaccacgcttccattgcagcaaaaatcgccagttacatttccgagggtcagttgattatccttaaccctgggcgtacgggtggagcgctggaattccggaaaatcctgcgtgaaaatggtgcgccggaggtaacgatcggggaaacctcaaacatgctctttacatgccgctccgagagaccaggacaggttacggtaaatgcgataacacgtgccatggactttgcatgtctcccagcggcaaaagctggatgggccctggaacagatagggtcggttcttcctcaataccaggctgtcgaaaacgtgttgcatacttcgctgactaatatcgaagctgtattgcacccgctgccaacactgttaaacgctgctcgttgtgagtctggtaccccattccattattataccgaggggattacgccatcagtcggggcgcttgcggagaaagtggacgctgaacgcatagcaatcgcaaaggctttcgatttaaacgttccgtcggtctgcgaatgggttaagattagttacggcctgaccccggccacaatttatgaagcggtgcagggtaatcctgtgctgcgcggcattatgggacctaccagccttaacacggtgcacttcagcgaggatgtaagcaccggactggtaccgttatccgaactgggtcgggtggtgaatgtgcctaccccacttatcgatgctgttcttctgttgatcagtgcgctgatagacgtggatttcagaaaggaaggtcgtaccttggaaaaattaggtctgagcggacttaccgccgcggaaataagaagtgctgttgag

SEQ ID NO: 628 - protein, 359 aa, Artificial Sequence
  Engineered variant of opine dehydrogenase CENDH
MIESKTYAVLGLGNGGHAFAAYLALKGQRVLAWDIDAQRIKEIQDRGAIIAEGPGLAGTAHPDLLTSDIGLAVKDADVILIVVPAIHHASIAAKIASYISEGQLIILNPGRTGGALEFRKILRENGAPEVTIGETSNMLFTCRSERPGQVTVNAITRAMDFACLPAAKAGWALEQIGSVLPQYQAVENVLHTSLTNIEAVLHPLPTLLNAARCESGTPFHYYTEGITPSVGALAEKVDAERIAIAKAFDLNVPSVCEWVKISYGLTPATIYEAVQGNPVLRGIMGPTSLNTVHFSEDVSTGLVPLSELGRVVNVPTPLIDAVLLLISALIDVDFRKEGRTLEKLGLSGLTAAEIRSAVE

SEQ ID NO: 629 - DNA, 1077 bp, Artificial Sequence
  Engineered variant of opine dehydrogenase CENDH
atgatcgagtcaaaaacatacgccgttttgggattaggaaacgggggtcacgcatttgccgcctatttagcattgaagggccagcgtgtactggcttgggacatcgatgctcagagaatcaaagagattcaggaccgtggagccatcatagcggaaggaccaggacttgctgggactgctcacccggatcttctgacctcagatataggtgtggcggttaaagacgctgatgtgatactgattgtagtgccggccatccaccacgcttccattgcagcaaaaatcgccagttacatttccgagggtcagttgattatccttaaccctgggcgtacgggtggagcgctggaattccggaaaatcctgcgtgaaaatggtgcgccggaggtaacgatcggggaaacctcaaacatgctctttacatgccgctccgagagaccaggacaggttacggtaaatgcgataacacgtgccatggactttgcatgtctcccagcggcaaaagctggatgggccctggaacagatagggtcggttcttcctcaatgccaggctgtcgaaaacgtgttgcatacttcgctgactaatatcgaagctgtattgcacccgctgccaacactgttaaacgctgctcgttgtgagtctggtaccccattccattattataccgaggggattacgccatcagtcggggcgcttgcggagaaagtggacgctgaacgcatagcaatcgcaaaggctttcgatttaaacgttccgtcggtctgcgaatgggttaagattagttacggccagaccccggccacaatttatgaagcggtgcagggtaatcctgtgctgcgcggcattatgggacctaccagccttaacacggtgcacttcagcgaggatgtaagcaccggactggtaccgttatccgaactgggtcgggtggtgaatgtgcctaccccacttatcgatgctgttcttctgttgatcagttcgctgatagacgtggatttcagaaaggaaggtcgtaccttggaaaaattaggtctgagcggacttaccgccgcggaaataagaagtgctgttgag

SEQ ID NO: 630 - protein, 359 aa, Artificial Sequence
  Engineered variant of opine dehydrogenase CENDH
MIESKTYAVLGLGNGGHAFAAYLALKGQRVLAWDIDAQRIKEIQDRGAIIAEGPGLAGTAHPDLLTSDIGVAVKDADVILIVVPAIHHASIAAKIASYISEGQLIILNPGRTGGALEFRKILRENGAPEVTIGETSNMLFTCRSERPGQVTVNAITRAMDFACLPAAKAGWALEQIGSVLPQCQAVENVLHTSLTNIEAVLHPLPTLLNAARCESGTPFHYYTEGITPSVGALAEKVDAERIAIAKAFDLNVPSVCEWVKISYGQTPATIYEAVQGNPVLRGIMGPTSLNTVHFSEDVSTGLVPLSELGRVVNVPTPLIDAVLLLISSLIDVDFRKEGRTLEKLGLSGLTAAEIRSAVE

SEQ ID NO: 631 - DNA, 1077 bp, Artificial Sequence
  Engineered variant of opine dehydrogenase CENDH
atgatcgagtcaaaaacatacgccgttttgggattaggaaacgggggtcacgcatttgccgcctatttagcattgaagggccagcgtgtactggcttgggacatcgatgctcagagaatcaaagagattcaggaccgtggagccatcatagcggaaggaccaggacttgctgggactgctcacccggatcttctgacctcagatataggtttggcggttaaagacgctgatgtgatactgattgtagtgccggccatccaccacgcttccattgcagcaaaaatcgccagttacatttccgagggtcagttgattatccttaaccctgggcgtacgggtggagcgctggaattccggaaaatcctgcgtgaaaatggtgcgccggaggtaacgatcggggaaacctcaaacatgctctttacatgccgctccgagagaccaggacaggttacggtaaatgcgataacacgtgccatggactttgcatgtctcccagcggcaaaagctggatgggccctggaacagatacattcggttcttcctcaataccaggctgtcgaaaacgtgttgcatacttcgctgactaatatcgaagctgtattgcacccgctgccaacactgttaaacgctgctcgttgtgagtctggtaccccattccattattataccgaggggattacgccatcagtcggggcgcttgcggagaaagtggacgctgaacgcatagcaatcgcaaaggctttcgatttaaacgttccgtcggtctgcgaatgggttaagattagttacggccagtcaccggccacaatttatgaagcggtgcagggtaatcctgtgctgcgcggcattatgggacctaccagccttaacacggtgcacttcttcgaggatgtaagcaccggactggtaccgttatccgaactgggtcgggtggtgaatgtgcctaccccacttatcgatgctgttcttctgttgatcagttcgctgatagacgtggatttcagaaaggaaggtcgtaccttggaaaaattaggtctgagcggacttaccgccgcggaaataagaagtgctgttgag

SEQ ID NO: 632 - protein, 359 aa, Artificial Sequence
  Engineered variant of opine dehydrogenase CENDH
MIESKTYAVLGLGNGGHAFAAYLALKGQRVLAWDIDAQRIKEIQDRGAIIAEGPGLAGTAHPDLLTSDIGLAVKDADVILIVVPAIHHASIAAKIASYISEGQLIILNPGRTGGALEFRKILRENGAPEVTIGETSNMLFTCRSERPGQVTVNAITRAMDFACLPAAKAGWALEQIHSVLPQYQAVENVLHTSLTNIEAVLHPLPTLLNAARCESGTPFHYYTEGITPSVGALAEKVDAERIAIAKAFDLNVPSVCEWVKISYGQSPATIYEAVQGNPVLRGIMGPTSLNTVHFFEDVSTGLVPLSELGRVVNVPTPLIDAVLLLISSLIDVDFRKEGRTLEKLGLSGLTAAEIRSAVE

SEQ ID NO: 633 - DNA, 1077 bp, Artificial Sequence
  Engineered variant of opine dehydrogenase CENDH
atgatcgagtcaaaaacatacgccgttttgggattaggaaacgggggtcacgcatttgccgcctatttagcattgaagggccagcgtgtactggcttgggacatcgatgctcagagaatcaaagagattcaggaccgtggagccatcatagcggaaggaccaggacttgctgggactgctcacccggatcttctgacctcagatataggtgtggcggttaaagacgctgatgtgatactgattgtagtgccggccatccaccacgcttccattgcagcacgtatcgccagttacatttccgagggtcagttgattatccttaaccctgggcgtacgggtggagcgctggaattccggaaaatcctgcgtgaaaatggtgcgccggaggtaacgatcggggaaacctcaaacatgctctttacatgccgctccgagagaccaggacaggttacggtaaatgcgataacacgtgccatggactttgcatgtctcccagcggcaaaagctggatgggccctggaacagatagggtcggttcttcctcaataccaggctgtcgaaaacgtgttgcatacttcgctgactaatatcgaagctgtattgcacccgctgccaacactgttaaacgctgctcgttgtgagtctggtaccccattccattattataccgaggggattacgccatcagtcggggcgcttgcggagaaagtggacgctgaacgcatagcaatcgcaaaggctttcgatttaaacgttccgtcggtctgcgaatgggttaagattagttacggccagtcaccggccacaatttatgaagcggtgcagggtaatcctgtgctgcgcggcattatgggacctaccagccttaacacggtgcacttcagcgaggatgtaagcaccggactggtaccgttatccgaactgggtcgggtggtgaatgtgcctaccccacttatcgatgctgttcttctgttgatcagttcgctgatagacgtggatttcagaaaggaaggtcgtaccttggaaaaattaggtctgagcggacttaccgccgcggaaataagaagtgctgttgag

SEQ ID NO: 634 - protein, 359 aa, Artificial Sequence
  Engineered variant of opine dehydrogenase CENDH
MIESKTYAVLGLGNGGHAFAAYLALKGQRVLAWDIDAQRIKEIQDRGAIIAEGPGLAGTAHPDLLTSDIGVAVKDADVILIVVPAIHHASIAARIASYISEGQLIILNPGRTGGALEFRKILRENGAPEVTIGETSNMLFTCRSERPGQVTVNAITRAMDFACLPAAKAGWALEQIGSVLPQYQAVENVLHTSLTNIEAVLHPLPTLLNAARCESGTPFHYYTEGITPSVGALAEKVDAERIAIAKAFDLNVPSVCEWVKISYGQSPATIYEAVQGNPVLRGIMGPTSLNTVHFSEDVSTGLVPLSELGRVVNVPTPLIDAVLLLISSLIDVDFRKEGRTLEKLGLSGLTAAEIRSAVE

SEQ ID NO: 635 - DNA, 1077 bp, Artificial Sequence
  Engineered variant of opine dehydrogenase CENDH
atgatcgagtcaaaaacatacgccgttttgggattaggaaacgggggtcacgcatttgccgcctatttagcattgaagggccagcgtgtactggcttgggacatcgatgctcagagaatcaaagagattcaggaccgtggagccatcatagcggaaggaccaggacttgctgggactgctcacccggatcttctgacctcagatataggtttggcggttaaagacgctgatgtgatactgattgtagtgccggccatccaccacgcttccattgcagcaaccatcgccagttacatttccgagggtcagttgattatccttaaccctgggcgtacgggtggagcgctggaattccggaaaatcctgcgtgaaaatggtgcgccggaggtaacgatcggggaaacctcaaacatgctctttacatgccgctccgagagaccaggacaggttacggtaaatgcgataacacgtgccatggactttgcatgtctcccagcggcaaaagctggatgggccctggaacagatacattcggttcttcctcaataccaggctgtcgaaaacgtgttgcatacttcgctgactaatatcgaagctgtattgcacccgctgccaacactgttaaacgctgctcgttgtgagtctggtaccccattccattattataccgaggggattacgccatcagtcggggcgcttgcggagaaagtggacgctgaacgcatagcaatcgcaaaggctttcgatttaaacgttccgtcggtctgcgaatgggttaagattagttacggccagtcaccggccacaatttatgaagcggtgcagggtaatcctgtgctgcgcggcattatgggacctaccagccttaacacggtgcacttcagcgaggatgtaagcaccggactggtaccgttatccgaactgggtcgggtggtgaatgtgcctaccccacttatcgatgctgttcttctgttgatcagtgaactgatagacgtggatttcagaaaggaaggtcgtaccttggaaaaattaggtctgagcggacttaccgccgcggaaataagaagtgctgttgag

SEQ ID NO: 636 - protein, 359 aa, Artificial Sequence
  Engineered variant of opine dehydrogenase CENDH
MIESKTYAVLGLGNGGHAFAAYLALKGQRVLAWDIDAQRIKEIQDRGAIIAEGPGLAGTAHPDLLTSDIGLAVKDADVILIVVPAIHHASIAATIASYISEGQLIILNPGRTGGALEFRKILRENGAPEVTIGETSNMLFTCRSERPGQVTVNAITRAMDFACLPAAKAGWALEQIHSVLPQYQAVENVLHTSLTNIEAVLHPLPTLLNAARCESGTPFHYYTEGITPSVGALAEKVDAERIAIAKAFDLNVPSVCEWVKISYGQSPATIYEAVQGNPVLRGIMGPTSLNTVHFSEDVSTGLVPLSELGRVVNVPTPLIDAVLLLISELIDVDFRKEGRTLEKLGLSGLTAAEIRSAVE

SEQ ID NO: 637 - DNA, 1077 bp, Artificial Sequence
  Engineered variant of opine dehydrogenase CENDH
atgatcgagtcaaaaacatacgccgttttgggattaggaaacgggggtcacgcatttgccgcctatttagcattgaagggccagcgtgtactggcttgggacatcgatgctcagagaatcaaagagattcaggaccgtggagccatcatagcggaaggaccaggacttgctgggactgctcacccggatcttctgacctcagatataggtttggcggttaaagacgctgatgtgatactgattgtagtgccggccatccaccacgcttccattgcagcacgtatcgccagttacatttccgagggtcagttgattatccttaaccctgggcgtacgggtggagcgctggaattccggaaaatcctgcgtgaaaatggtgcgccggaggtaacgatcggggaaacctcaaacatgctctttacatgccgctccgagagaccaggacaggttacggtaaatgcgataacacgtgccatggactttgcatgtctcccagcggcaaaagctggatgggccctggaacagatagggtcggttcttcctcaatgccaggctgtcgaaaacgtgttgcatacttcgctgactaatatcgaagctgtattgcacccgctgccaacactgttaaacgctgctcgttgtgagtctggtaccccattccattattataccgaggggattacgccatcagtcggggcgcttgcggagaaagtggacgctgaacgcatagcaatcgcaaaggctttcgatttaaacgttccgtcggtctgcgaatgggttaagattagttacggccagtcaccggccacaatttatgaagcggtgcagggtaatcctgtgctgcgcggcattatgggacctaccagccttaacacggtgcacttcttcgaggatgtaagcaccggactggtaccgttatccgaactgggtcggaccgtgaatgtgcctaccccacttatcgatgctgttcttctgttgatcagtgaactgatagacgtggatttcagaaaggaaggtcgtaccttggaaaaattaggtctgagcggacttaccgccgcggaaataagaagtgctgttgag

SEQ ID NO: 638 - protein, 359 aa, Artificial Sequence
  Engineered variant of opine dehydrogenase CENDH
MIESKTYAVLGLGNGGHAFAAYLALKGQRVLAWDIDAQRIKEIQDRGAIIAEGPGLAGTAHPDLLTSDIGLAVKDADVILIVVPAIHHASIAARIASYISEGQLIILNPGRTGGALEFRKILRENGAPEVTIGETSNMLFTCRSERPGQVTVNAITRAMDFACLPAAKAGWALEQIGSVLPQCQAVENVLHTSLTNIEAVLHPLPTLLNAARCESGTPFHYYTEGITPSVGALAEKVDAERIAIAKAFDLNVPSVCEWVKISYGQSPATIYEAVQGNPVLRGIMGPTSLNTVHFFEDVSTGLVPLSELGRTVNVPTPLIDAVLLLISELIDVDFRKEGRTLEKLGLSGLTAAEIRSAVE

SEQ ID NO: 639 - DNA, 1077 bp, Artificial Sequence
  Engineered variant of opine dehydrogenase CENDH
atgatcgagtcaaaaacatacgccgttttgggattaggaaacgggggtcacgcatttgccgcctatttagcattgaagggccagcgtgtactggcttgggacatcgatgctcagagaatcaaagagattcaggaccgtggagccatcatagcggaaggaccaggacttgctgggactgctcacccggatcttctgacctcagatataggtttggcggttaaagacgctgatgtgatactgattgtagtgccggccatccaccacgcttccattgcagcaaaaatcgccagttacatttccgagggtcagttgattatccttaaccctgggcgtacgggtggagcgctggaattccggaaaatcctgcgtgaaaatggtgcgccggaggtaacgatcggggaaacctcaaacatgctctttacatgccgctccgagagaccaggacaggttacggtaaatgcgataacacgtgccatggactttgcatgtctcccagcggcaaaagctggatgggccctggaacagatagggtcggttcttcctcaataccaggctgtcgaaaacgtgttgcatacttcgctgactaatatcgaagctgtattgcacccgctgccaacactgttaaacgctgctcgttgtgagtctggtaccccattccattattataccgaggggattacgccatcagtcggggcgcttgcggagaaagtggacgctgaacgcatagcaatcgcaaaggctttcgatttaaacgttccgtcggtctgcgaatgggttaagattagttacggccagaccccggccacaatttatgaagcggtgcagggtaatcctgtgctgcgcggcattatgggacctaccagccttaacacggtgcacttcagcgaggatgtaagcaccggactggtaccgttatccgaactgggtcgggtggtgaatgtgcctaccccacttatcgatgctgttcttctgttgatcagttcgctgatagacgtggatttcagaaaggaaggtcgtaccttggaaaaattaggtctgagcggacttaccgccgcggaaataagaagtgctgttgag

SEQ ID NO: 640 - protein, 359 aa, Artificial Sequence
  Engineered variant of opine dehydrogenase CENDH
MIESKTYAVLGLGNGGHAFAAYLALKGQRVLAWDIDAQRIKEIQDRGAIIAEGPGLAGTAHPDLLTSDIGLAVKDADVILIVVPAIHHASIAAKIASYISEGQLIILNPGRTGGALEFRKILRENGAPEVTIGETSNMLFTCRSERPGQVTVNAITRAMDFACLPAAKAGWALEQIGSVLPQYQAVENVLHTSLTNIEAVLHPLPTLLNAARCESGTPFHYYTEGITPSVGALAEKVDAERIAIAKAFDLNVPSVCEWVKISYGQTPATIYEAVQGNPVLRGIMGPTSLNTVHFSEDVSTGLVPLSELGRVVNVPTPLIDAVLLLISSLIDVDFRKEGRTLEKLGLSGLTAAEIRSAVE

SEQ ID NO: 641 - DNA, 1077 bp, Artificial Sequence
  Engineered variant of opine dehydrogenase CENDH
atgatcgagtcaaaaacatacgccgttttgggattaggaaacgggggtcacgcatttgccgcctatttagcattgaagggccagcgtgtactggcttgggacatcgatgctcagagaatcaaagagattcaggaccgtggagccatcatagcggaaggaccaggacttgctgggactgctcacccggatcttctgacctcagatataggtttggcggttaaagacgctgatgtgatactgattgtagtgccggccatccaccacgcttccattgcagcacgtatcgccagttacatttccgagggtcagttgattatccttaaccctgggcgtacgggtggagcgctggaattccggaaaatcctgcgtgaaaatggtgcgccggaggtaacgatcggggaaacctcaaacatgctctttacatgccgctccgagagaccaggacaggttacggtaaatgcgataacactggccatggactttgcatgtctcccagcggcaaaagctggatgggccctggaacagatagggtcggttcttcctcaatgccaggctgtcgaaaacgtgttgcatacttcgctgactaatatcgaagctgtattgcacccgctgccaacactgttaaacgctgctcgttgtgagtctggtaccccattccattattataccgaggggattacgccatcagtcggggcgcttgcggagaaagtggacgctgaacgcatagcaatcgcaaaggctttcgatttaaacgttccgtcggtctgcgaatgggttaagattagttacggcctgtcaccggccacaatttatgaagcggtgcagggtaatcctgtgctgcgcggcattatgggacctaccagccttaacacggtgcacttcttcgaggatgtaagcaccggactggtaccgttatccgaactgggtcgggtggtgaatgtgcctaccccacttatcgatgctgttcttctgttgatcagttcgctgatagacgtggatttcagaaaggaaggtcgtaccttggaaaaattaggtctgagcggacttaccgccgcggaaataagaagtgctgttgag

SEQ ID NO: 642 - protein, 359 aa, Artificial Sequence
  Engineered variant of opine dehydrogenase CENDH
MIESKTYAVLGLGNGGHAFAAYLALKGQRVLAWDIDAQRIKEIQDRGAIIAEGPGLAGTAHPDLLTSDIGLAVKDADVILIVVPAIHHASIAARIASYISEGQLIILNPGRTGGALEFRKILRENGAPEVTIGETSNMLFTCRSERPGQVTVNAITLAMDFACLPAAKAGWALEQIGSVLPQCQAVENVLHTSLTNIEAVLHPLPTLLNAARCESGTPFHYYTEGITPSVGALAEKVDAERIAIAKAFDLNVPSVCEWVKISYGLSPATIYEAVQGNPVLRGIMGPTSLNTVHFFEDVSTGLVPLSELGRVVNVPTPLIDAVLLLISSLIDVDFRKEGRTLEKLGLSGLTAAEIRSAVE

SEQ ID NO: 643 - DNA, 1077 bp, Artificial Sequence
  Engineered variant of opine dehydrogenase CENDH
atgatcgagtcaaaaacatacgccgttttgggattaggaaacgggggtcacgcatttgccgcctatttagcattgaagggccagcgtgtactggcttgggacatcgatgctcagagaatcaaagagattcaggaccgtggagccatcatagcggaaggaccaggacttgctgggactgctcacccggatcttctgacctcagatataggttgcgcggttaaagacgctgatgtgatactgattgtagtgccggccatccaccacgcttccattgcagcacgtatcgccagttacatttccgagggtcagttgattatccttaaccctgggcgtacgggtggagcgctggaattccggaaaatcctgcgtgaaaatggtgcgccggaggtaacgatcggggaaacctcaaacatgctctttacatgccgctccgagagaccaggacaggttacggtaaatgcgataacactggccatggactttgcatgtctcccagcggcaaaagctggatgggccctggaacagatacattcggttcttcctcaataccaggctgtcgaaaacgtgttgcatacttcgctgactaatatcgaagctgtattgcacccgctgccaacactgttaaacgctgctcgttgtgagtctggtaccccattccattattataccgaggggattacgccatcagtcggggcgcttgcggagaaagtggacgctgaacgcatagcaatcgcaaaggctttcgatttaaacgttccgtcggtctgcgaatgggttaagattagttacggccagaccccggccacaatttatgaagcggtgcagggtaatcctgtgctgcgcggcattatgggacctaccagccttaacacggtgcacttcttcgaggatgtaagcaccggactggtaccgttatccgaactgggtcgggtggtgaatgtgcctaccccacttatcgatgctgttcttctgttgatcagtgaactgatagacgtggatttcagaaaggaaggtcgtaccttggaaaaattaggtctgagcggacttaccgccgcggaaataagaagtgctgttgag

SEQ ID NO: 644 - protein, 359 aa, Artificial Sequence
  Engineered variant of opine dehydrogenase CENDH
MIESKTYAVLGLGNGGHAFAAYLALKGQRVLAWDIDAQRIKEIQDRGAIIAEGPGLAGTAHPDLLTSDIGCAVKDADVILIVVPAIHHASIAARIASYISEGQLIILNPGRTGGALEFRKILRENGAPEVTIGETSNMLFTCRSERPGQVTVNAITLAMDFACLPAAKAGWALEQIHSVLPQYQAVENVLHTSLTNIEAVLHPLPTLLNAARCESGTPFHYYTEGITPSVGALAEKVDAERIAIAKAFDLNVPSVCEWVKISYGQTPATIYEAVQGNPVLRGIMGPTSLNTVHFFEDVSTGLVPLSELGRVVNVPTPLIDAVLLLISELIDVDFRKEGRTLEKLGLSGLTAAEIRSAVE

SEQ ID NO: 645 - DNA, 1077 bp, Artificial Sequence
  Engineered variant of opine dehydrogenase CENDH
atgatcgagtcaaaaacatacgccgttttgggattaggaaacgggggtcacgcatttgccgcctatttagcattgaagggccagcgtgtactggcttgggacatcgatgctcagagaatcaaagagattcaggaccgtggagccatcatagcggaaggaccaggacttgctgggactgctcacccggatcttctgacctcagatataggtttggcggttaaagacgctgatgtgatactgattgtagtgccggccatccaccacgcttccattgcagcaaaaatcgccagttacatttccgagggtcagttgattatccttaaccctgggcgtacgggtggagcgctggaattccggaaaatcctgcgtgaaaatggtgcgccggaggtaacgatcggggaaacctcaaacatgctctttacatgccgctccgagagaccaggacaggttacggtaaatgcgataacacgtgccatggactttgcatgtctcccagcggcaaaagctggatgggccctggaacagatacattcggttcttcctcaatgccaggctgtcgaaaacgtgttgcatacttcgctgactaatatcgaagctgtattgcacccgctgccaacactgttaaacgctgctcgttgtgagtctggtaccccattccattattataccgaggggattacgccatcagtcggggcgcttgcggagaaagtggacgctgaacgcatagcaatcgcaaaggctttcgatttaaacgttccgtcggtctgcgaatgggttaagattagttacggcctgaccccggccacaatttatgaagcggtgcagggtaatcctgtgctgcgcggcattatgggacctaccagccttaacacggtgcacttcttcgaggatgtaagcaccggactggtaccgttatccgaactgggtcgggcagtgaatgtgcctaccccacttatcgatgctgttcttctgttgatcagtgaactgatagacgtggatttcagaaaggaaggtcgtaccttggaaaaattaggtctgagcggacttaccgccgcggaaataagaagtgctgttgag

SEQ ID NO: 646 - protein, 359 aa, Artificial Sequence
  Engineered variant of opine dehydrogenase CENDH
MIESKTYAVLGLGNGGHAFAAYLALKGQRVLAWDIDAQRIKEIQDRGAIIAEGPGLAGTAHPDLLTSDIGLAVKDADVILIVVPAIHHASIAAKIASYISEGQLIILNPGRTGGALEFRKILRENGAPEVTIGETSNMLFTCRSERPGQVTVNAITRAMDFACLPAAKAGWALEQIHSVLPQCQAVENVLHTSLTNIEAVLHPLPTLLNAARCESGTPFHYYTEGITPSVGALAEKVDAERIAIAKAFDLNVPSVCEWVKISYGLTPATIYEAVQGNPVLRGIMGPTSLNTVHFFEDVSTGLVPLSELGRAVNVPTPLIDAVLLLISELIDVDFRKEGRTLEKLGLSGLTAAEIRSAVE

SEQ ID NO: 647 - DNA, 1077 bp, Artificial Sequence
  Engineered variant of opine dehydrogenase CENDH
atgatcgagtcaaaaacatacgccgttttgggattaggaaacgggggtcacgcatttgccgcctatttagcattgaagggccagcgtgtactggcttgggacatcgatgctcagagaatcaaagagattcaggaccgtggagccatcatagcggaaggaccaggacttgctgggactgctcacccggatcttctgacctcagatataggtttggcggttaaagacgctgatgtgatactgattgtagtgccggccatccaccacgcttccattgcagcaaaaatcgccagttacatttccgagggtcagttgattatccttaaccctgggcgtacgggtggagcgctggaattccggaaaatcctgcgtgaaaatggtgcgccggaggtaacgatcggggaaacctcaaacatgctctttacatgccgctccgagagaccaggacaggttacggtaaatgcgataacacgtgccatggactttgcatgtctcccagcggcaaaagctggatgggccctggaacagatagggtcggttcttcctcaataccaggctgtcgaaaacgtgttgcatacttcgctgactaatatcgaagctgtattgcacccgctgccaacactgttaaacgctgctcgttgtgagtctggtaccccattccattattataccgaggggattacgccatcagtcggggcgcttgcggagaaagtggacgctgaacgcatagcaatcgcaaaggctttcgatttaaacgttccgtcggtctgcgaatgggttaagattagttacggccagaccccggccacaatttatgaagcggtgcagggtaatcctgtgctgcgcggcattatgggacctaccagccttaacacggtgcacttcagcgaggatgtaagcaccggactggtaccgttatccgaactgggtcgggtggtgaatgtgcctaccccacttatcgatgctgttcttctgttgatcagtgaactgatagacgtggatttcagaaaggaaggtcgtaccttggaaaaattaggtctgagcggacttaccgccgcggaaataagaagtgctgttgag

SEQ ID NO: 648 - protein, 359 aa, Artificial Sequence
  Engineered variant of opine dehydrogenase CENDH
MIESKTYAVLGLGNGGHAFAAYLALKGQRVLAWDIDAQRIKEIQDRGAIIAEGPGLAGTAHPDLLTSDIGLAVKDADVILIVVPAIHHASIAAKIASYISEGQLIILNPGRTGGALEFRKILRENGAPEVTIGETSNMLFTCRSERPGQVTVNAITRAMDFACLPAAKAGWALEQIGSVLPQYQAVENVLHTSLTNIEAVLHPLPTLLNAARCESGTPFHYYTEGITPSVGALAEKVDAERIAIAKAFDLNVPSVCEWVKISYGQTPATIYEAVQGNPVLRGIMGPTSLNTVHFSEDVSTGLVPLSELGRVVNVPTPLIDAVLLLISELIDVDFRKEGRTLEKLGLSGLTAAEIRSAVE

SEQ ID NO: 649 - DNA, 1077 bp, Artificial Sequence
  Engineered variant of opine dehydrogenase CENDH
atgatcgagtcaaaaacatacgccgttttgggattaggaaacgggggtcacgcatttgccgcctatttagcattgaagggccagcgtgtactggcttgggacatcgatgctcagagaatcaaagagattcaggaccgtggagccatcatagcggaaggaccaggacttgctgggactgctcacccggatcttctgacctcagatataggtttggcggttaaagacgctgatgtgatactgattgtagtgccggccatccaccacgcttccattgcagcaaaaatcgccagttacatttccgagggtcagttgattatccttaaccctgggcgtacgggtggagcgctggaattccggaaaatcctgcgtgaaaatggtgcgccggaggtaacgatcggggaaacctcaaacatgctctttacatgccgctccgagagaccaggacaggttacggtaaattatataacactggccatggactttgcatgtctcccagcggcaaaagctggatgggccctggaacagatagggtcggttcttcctcaataccaggctgtcgaaaacgtgttgcatacttcgctgactaatatcgaagctgtattgcacccgctgccaacactgttaaacgctgctcgttgtgagtctggtaccccattccattattataccgaggggattacgccatcagtcggggcgcttgcggagaaagtggacgctgaacgcatagcaatcgcaaaggctttcgatttaaacgttccgtcggtctgcgaatgggttaagattagttacggccagtcaccggccacaatttatgaagcggtgcagggtaatcctgtgctgcgcggcattatgggacctaccagccttaacacggtgcacttcttcgaggatgtaagcaccggactggtaccgttatccgaactgggtcgggtggtgaatgtgcctaccccacttatcgatgctgttcttctgttgatcagttcgctgatagacgtggatttcagaaaggaaggtcgtaccttggaaaaattaggtctgagcggacttaccgccgcggaaataagaagtgctgttgag

SEQ ID NO: 650 - protein, 359 aa, Artificial Sequence
  Engineered variant of opine dehydrogenase CENDH
MIESKTYAVLGLGNGGHAFAAYLALKGQRVLAWDIDAQRIKEIQDRGAIIAEGPGLAGTAHPDLLTSDIGLAVKDADVILIVVPAIHHASIAAKIASYISEGQLIILNPGRTGGALEFRKILRENGAPEVTIGETSNMLFTCRSERPGQVTVNYITLAMDFACLPAAKAGWALEQIGSVLPQYQAVENVLHTSLTNIEAVLHPLPTLLNAARCESGTPFHYYTEGITPSVGALAEKVDAERIAIAKAFDLNVPSVCEWVKISYGQSPATIYEAVQGNPVLRGIMGPTSLNTVHFFEDVSTGLVPLSELGRVVNVPTPLIDAVLLLISSLIDVDFRKEGRTLEKLGLSGLTAAEIRSAVE

SEQ ID NO: 651 - DNA, 1077 bp, Artificial Sequence
  Engineered variant of opine dehydrogenase CENDH
atgatcgagtcaaaaacatacgccgttttgggattaggaaacgggggtcacgcatttgccgcctatttagcattgaagggccagcgtgtactggcttgggacatcgatgctcagagaatcaaagagattcaggaccgtggagccatcatagcggaaggaccaggacttgctgggactgctcacccggatcttctgacctcagatataggtgtggcggttaaagacgctgatgtgatactgattgtagtgccggccatccaccacgcttccattgcagcaaaaatcgccagttacatttccgagggtcagttgattatccttaaccctgggcgtacgggtggagcgctggaattccggaaaatcctgcgtgaaaatggtgcgccggaggtaacgatcggggaaacctcaaacatgctctttacatgccgctccgagagaccaggacaggttacggtaaatgcgataacactggccatggactttgcatgtctcccagcggcaaaagctggatgggccctggaacagatagggtcggttcttcctcaataccaggctgtcgaaaacgtgttgcatacttcgctgactaatatcgaagctgtattgcacccgctgccaacactgttaaacgctgctcgttgtgagtctggtaccccattccattattataccgaggggattacgccatcagtcggggcgcttgcggagaaagtggacgctgaacgcatagcaatcgcaaaggctttcgatttaaacgttccgtcggtctgcgaatgggttaagattagttacggccagtcaccggccacaatttatgaagcggtgcagggtaatcctgtgctgcgcggcattatgggacctaccagccttaacacggtgcacttcagcgaggatgtaagcaccggactggtaccgttatccgaactgggtcgggtggtgaatgtgcctaccccacttatcgatgctgttcttctgttgatcagttcgctgatagacgtggatttcagaaaggaaggtcgtaccttggaaaaattaggtctgagcggacttaccgccgcggaaataagaagtgctgttgag

SEQ ID NO: 652 - protein, 359 aa, Artificial Sequence
  Engineered variant of opine dehydrogenase CENDH
MIESKTYAVLGLGNGGHAFAAYLALKGQRVLAWDIDAQRIKEIQDRGAIIAEGPGLAGTAHPDLLTSDIGVAVKDADVILIVVPAIHHASIAAKIASYISEGQLIILNPGRTGGALEFRKILRENGAPEVTIGETSNMLFTCRSERPGQVTVNAITLAMDFACLPAAKAGWALEQIGSVLPQYQAVENVLHTSLTNIEAVLHPLPTLLNAARCESGTPFHYYTEGITPSVGALAEKVDAERIAIAKAFDLNVPSVCEWVKISYGQSPATIYEAVQGNPVLRGIMGPTSLNTVHFSEDVSTGLVPLSELGRVVNVPTPLIDAVLLLISSLIDVDFRKEGRTLEKLGLSGLTAAEIRSAVE

SEQ ID NO: 653 - DNA, 1077 bp, Artificial Sequence
  Engineered variant of opine dehydrogenase CENDH
atgatcgagtcaaaaacatacgccgttttgggattaggaaacgggggtcacgcatttgccgcctatttagcattgaagggccagcgtgtactggcttgggacatcgatgctcagagaatcaaagagattcaggaccgtggagccatcatagcggaaggaccaggacttgctgggactgctcacccggatcttctgacctcagatataggttgcgcggttaaagacgctgatgtgatactgattgtagtgccggccatccaccacgcttccattgcagcacgtatcgccagttacatttccgagggtcagttgattatccttaaccctgggcgtacgggtggagcgctggaattccggaaaatcctgcgtgaaaatggtgcgccggaggtaacgatcggggaaacctcaaacatgctctttacatgccgctccgagagaccaggacaggttacggtaaatgcgataacacgtgccatggactttgcatgtctcccagcggcaaaagctggatgggccctggaacagatacattcggttcttcctcaataccaggctgtcgaaaacgtgttgcatacttcgctgactaatatcgaagctgtattgcacccgctgccaacactgttaaacgctgctcgttgtgagtctggtaccccattccattattataccgaggggattacgccatcagtcggggcgcttgcggagaaagtggacgctgaacgcatagcaatcgcaaaggctttcgatttaaacgttccgtcggtctgcgaatgggttaagattagttacggcctgtcaccggccacaatttatgaagcggtgcagggtaatcctgtgctgcgcggcattatgggacctaccagccttaacacggtgcacttcagcgaggatgtaagcaccggactggtaccgttatccgaactgggtcgggtggtgaatgtgcctaccccacttatcgatgctgttcttctgttgatcagtgcgctgatagacgtggatttcagaaaggaaggtcgtaccttggaaaaattaggtctgagcggacttaccgccgcggaaataagaagtgctgttgag

SEQ ID NO: 654 - protein, 359 aa, Artificial Sequence
  Engineered variant of opine dehydrogenase CENDH
MIESKTYAVLGLGNGGHAFAAYLALKGQRVLAWDIDAQRIKEIQDRGAIIAEGPGLAGTAHPDLLTSDIGCAVKDADVILIVVPAIHHASIAARIASYISEGQLIILNPGRTGGALEFRKILRENGAPEVTIGETSNMLFTCRSERPGQVTVNAITRAMDFACLPAAKAGWALEQIHSVLPQYQAVENVLHTSLTNIEAVLHPLPTLLNAARCESGTPFHYYTEGITPSVGALAEKVDAERIAIAKAFDLNVPSVCEWVKISYGLSPATIYEAVQGNPVLRGIMGPTSLNTVHFSEDVSTGLVPLSELGRVVNVPTPLIDAVLLLISALIDVDFRKEGRTLEKLGLSGLTAAEIRSAVE

SEQ ID NO: 655 - DNA, 1077 bp, Artificial Sequence
  Engineered variant of opine dehydrogenase CENDH
atgatcgagtcaaaaacatacgccgttttgggattaggaaacgggggtcacgcatttgccgcctatttagcattgaagggccagcgtgtactggcttgggacatcgatgctcagagaatcaaagagattcaggaccgtggagccatcatagcggaaggaccaggacttgctgggactgctcacccggatcttctgacctcagatataggtttggcggttaaagacgctgatgtgatactgattgtagtgccggccatccaccacgcttccattgcagcaaaaatcgccagttacatttccgagggtcagttgattatccttaaccctgggcgtacgggtggagcgctggaattccggaaaatcctgcgtgaaaatggtgcgccggaggtaacgatcggggaaacctcaaacatgctctttacatgccgctccgagagaccaggacaggttacggtaaatgcgataacactggccatggactttgcatgtctcccagcggcaaaagctggatgggccctggaacagatacattcggttcttcctcaataccaggctgtcgaaaacgtgttgcatacttcgctgactaatatcgaagctgtattgcacccgctgccaacactgttaaacgctgctcgttgtgagtctggtaccccattccattattataccgaggggattacgccatcagtcggggcgcttgcggagaaagtggacgctgaacgcatagcaatcgcaaaggctttcgatttaaacgttccgtcggtctgcgaatgggttaagattagttacggcctgtcaccggccacaatttatgaagcggtgcagggtaatcctgtgctgcgcggcattatgggacctaccagccttaacacggtgcacttcttcgaggatgtaagcaccggactggtaccgttatccgaactgggtcgggtggtgaatgtgcctaccccacttatcgatgctgttcttctgttgatcagtgaactgatagacgtggatttcagaaaggaaggtcgtaccttggaaaaattaggtctgagcggacttaccgccgcggaaataagaagtgctgttgag

SEQ ID NO: 656 - protein, 359 aa, Artificial Sequence
  Engineered variant of opine dehydrogenase CENDH
MIESKTYAVLGLGNGGHAFAAYLALKGQRVLAWDIDAQRIKEIQDRGAIIAEGPGLAGTAHPDLLTSDIGLAVKDADVILIVVPAIHHASIAAKIASYISEGQLIILNPGRTGGALEFRKILRENGAPEVTIGETSNMLFTCRSERPGQVTVNAITLAMDFACLPAAKAGWALEQIHSVLPQYQAVENVLHTSLTNIEAVLHPLPTLLNAARCESGTPFHYYTEGITPSVGALAEKVDAERIAIAKAFDLNVPSVCEWVKISYGLSPATIYEAVQGNPVLRGIMGPTSLNTVHFFEDVSTGLVPLSELGRVVNVPTPLIDAVLLLISELIDVDFRKEGRTLEKLGLSGLTAAEIRSAVE

SEQ ID NO: 657 - DNA, 1077 bp, Artificial Sequence
  Engineered variant of opine dehydrogenase CENDH
atgatcgagtcaaaaacatacgccgttttgggattaggaaacgggggtcacgcatttgccgcctatttagcattgaagggccagcgtgtactggcttgggacatcgatgctcagagaatcaaagagattcaggaccgtggagccatcatagcggaaggaccaggacttgctgggactgctcacccggatcttctgacctcagatataggtttggcggttaaagacgctgatgtgatactgattgtagtgccggccatccaccacgcttccattgcagcacgtatcgccagttacatttccgagggtcagttgattatccttaaccctgggcgtacgggtggagcgctggaattccggaaaatcctgcgtgaaaatggtgcgccggaggtaacgatcggggaaacctcaaacatgctctttacatgccgctccgagagaccaggacaggttacggtaaattatataacacgtgccatggactttgcatgtctcccagcggcaaaagctggatgggccctggaacagatagggtcggttcttcctcaataccaggctgtcgaaaacgtgttgcatacttcgctgactaatatcgaagctgtattgcacccgctgccaacactgttaaacgctgctcgttgtgagtctggtaccccattccattattataccgaggggattacgccatcagtcggggcgcttgcggagaaagtggacgctgaacgcatagcaatcgcaaaggctttcgatttaaacgttccgtcggtctgcgaatgggttaagattagttacggccagtcaccggccacaatttatgaagcggtgcagggtaatcctgtgctgcgcggcattatgggacctaccagccttaacacggtgcacttcttcgaggatgtaagcaccggactggtaccgttatccgaactgggtcgggtggtgaatgtgcctaccccacttatcgatgctgttcttctgttgatcagtgcgctgatagacgtggatttcagaaaggaaggtcgtaccttggaaaaattaggtctgagcggacttaccgccgcggaaataagaagtgctgttgag

SEQ ID NO: 658 - protein, 359 aa, Artificial Sequence
  Engineered variant of opine dehydrogenase CENDH
MIESKTYAVLGLGNGGHAFAAYLALKGQRVLAWDIDAQRIKEIQDRGAIIAEGPGLAGTAHPDLLTSDIGLAVKDADVILIVVPAIHHASIAARIASYISEGQLIILNPGRTGGALEFRKILRENGAPEVTIGETSNMLFTCRSERPGQVTVNYITRAMDFACLPAAKAGWALEQIGSVLPQYQAVENVLHTSLTNIEAVLHPLPTLLNAARCESGTPFHYYTEGITPSVGALAEKVDAERIAIAKAFDLNVPSVCEWVKISYGQSPATIYEAVQGNPVLRGIMGPTSLNTVHFFEDVSTGLVPLSELGRVVNVPTPLIDAVLLLISALIDVDFRKEGRTLEKLGLSGLTAAEIRSAVE

SEQ ID NO: 659 - DNA, 1077 bp, Artificial Sequence
  Engineered variant of opine dehydrogenase CENDH
atgatcgagtcaaaaacatacgccgttttgggattaggaaacgggggtcacgcatttgccgcctatttagcattgaagggccagcgtgtactggcttgggacatcgatgctcagagaatcaaagagattcaggaccgtggagccatcatagcggaaggaccaggacttgctgggactgctcacccggatcttctgacctcagatataggtttggcggttaaagacgctgatgtgatactgattgtagtgccggccatccaccacgcttccattgcagcaaaaatcgccagttacatttccgagggtcagttgattatccttaaccctgggcgtacgggtggagcgctggaattccggaaaatcctgcgtgaaaatggtgcgccggaggtaacgatcggggaaacctcaaacatgctctttacatgccgctccgagagaccaggacaggttacggtaaattatataacacgtgccatggactttgcatgtctcccagcggcaaaagctggatgggccctggaacagatacattcggttcttcctcaataccaggctgtcgaaaacgtgttgcatacttcgctgactaatatcgaagctgtattgcacccgctgccaacactgttaaacgctgctcgttgtgagtctggtaccccattccattattataccgaggggattacgccatcagtcggggcgcttgcggagaaagtggacgctgaacgcatagcaatcgcaaaggctttcgatttaaacgttccgtcggtctgcgaatgggttaagattagttacggcctgaccccggccacaatttatgaagcggtgcagggtaatcctgtgctgcgcggcattatgggacctaccagccttaacacggtgcacttcagcgaggatgtaagcaccggactggtaccgttatccgaactgggtcgggcagtgaatgtgcctaccccacttatcgatgctgttcttctgttgatcagtgaactgatagacgtggatttcagaaaggaaggtcgtaccttggaaaaattaggtctgagcggacttaccgccgcggaaataagaagtgctgttgag

SEQ ID NO: 660 - protein, 359 aa, Artificial Sequence
  Engineered variant of opine dehydrogenase CENDH
MIESKTYAVLGLGNGGHAFAAYLALKGQRVLAWDIDAQRIKEIQDRGAIIAEGPGLAGTAHPDLLTSDIGLAVKDADVILIVVPAIHHASIAAKIASYISEGQLIILNPGRTGGALEFRKILRENGAPEVTIGETSNMLFTCRSERPGQVTVNYITRAMDFACLPAAKAGWALEQIHSVLPQYQAVENVLHTSLTNIEAVLHPLPTLLNAARCESGTPFHYYTEGITPSVGALAEKVDAERIAIAKAFDLNVPSVCEWVKISYGLTPATIYEAVQGNPVLRGIMGPTSLNTVHFSEDVSTGLVPLSELGRAVNVPTPLIDAVLLLISELIDVDFRKEGRTLEKLGLSGLTAAEIRSAVE

SEQ ID NO: 661 - DNA, 1077 bp, Artificial Sequence
  Engineered variant of opine dehydrogenase CENDH
atgatcgagtcaaaaacatacgccgttttgggattaggaaacgggggtcacgcatttgccgcctatttagcattgaagggccagcgtgtactggcttgggacatcgatgctcagagaatcaaagagattcaggaccgtggagccatcatagcggaaggaccaggacttgctgggactgctcacccggatcttctgacctcagatataggttgcgcggttaaagacgctgatgtgatactgattgtagtgccggccatccaccacgcttccattgcagcacgtatcgccagttacatttccgagggtcagttgattatccttaaccctgggcgtacgggtggagcgctggaattccggaaaatcctgcgtgaaaatggtgcgccggaggtaacgatcggggaaacctcaaacatgctctttacatgccgctccgagagaccaggacaggttacggtaaatgcgataacactggccatggactttgcatgtctcccagcggcaaaagctggatgggccctggaacagatacattcggttcttcctcaataccaggctgtcgaaaacgtgttgcatacttcgctgactaatatcgaagctgtattgcacccgctgccaacactgttaaacgctgctcgttgtgagtctggtaccccattccattattataccgaggggattacgccatcagtcggggcgcttgcggagaaagtggacgctgaacgcatagcaatcgcaaaggctttcgatttaaacgttccgtcggtctgcgaatgggttaagattagttacggccagtcaccggccacaatttatgaagcggtgcagggtaatcctgtgctgcgcggcattatgggacctaccagccttaacacggtgcacttcttcgaggatgtaagcaccggactggtaccgttatccgaactgggtcgggtggtgaatgtgcctaccccacttatcgatgctgttcttctgttgatcagttcgctgatagacgtggatttcagaaaggaaggtcgtaccttggaaaaattaggtctgagcggacttaccgccgcggaaataagaagtgctgttgag

SEQ ID NO: 662 - protein, 359 aa, Artificial Sequence
  Engineered variant of opine dehydrogenase CENDH
MIESKTYAVLGLGNGGHAFAAYLALKGQRVLAWDIDAQRIKEIQDRGAIIAEGPGLAGTAHPDLLTSDIGCAVKDADVILIVVPAIHHASIAARIASYISEGQLIILNPGRTGGALEFRKILRENGAPEVTIGETSNMLFTCRSERPGQVTVNAITLAMDFACLPAAKAGWALEQIHSVLPQYQAVENVLHTSLTNIEAVLHPLPTLLNAARCESGTPFHYYTEGITPSVGALAEKVDAERIAIAKAFDLNVPSVCEWVKISYGQSPATIYEAVQGNPVLRGIMGPTSLNTVHFFEDVSTGLVPLSELGRVVNVPTPLIDAVLLLISSLIDVDFRKEGRTLEKLGLSGLTAAEIRSAVE

SEQ ID NO: 663 - DNA, 1077 bp, Artificial Sequence
  Engineered variant of opine dehydrogenase CENDH
atgatcgagtcaaaaacatacgccgttttgggattaggaaacgggggtcacgcatttgccgcctatttagcattgaagggccagcgtgtactggcttgggacatcgatgctcagagaatcaaagagattcaggaccgtggagccatcatagcggaaggaccaggacttgctgggactgctcacccggatcttctgacctcagatataggtgtggcggttaaagacgctgatgtgatactgattgtagtgccggccatccaccacgcttccattgcagcaaaaatcgccagttacatttccgagggtcagttgattatccttaaccctgggcgtacgggtggagcgctggaattccggaaaatcctgcgtgaaaatggtgcgccggaggtaacgatcggggaaacctcaaacatgctctttacatgccgctccgagagaccaggacaggttacggtaaatgcgataacacgtgccatggactttgcatgtctcccagcggcaaaagctggatgggccctggaacagatagggtcggttcttcctcaataccaggctgtcgaaaacgtgttgcatacttcgctgactaatatcgaagctgtattgcacccgctgccaacactgttaaacgctgctcgttgtgagtctggtaccccattccattattataccgaggggattacgccatcagtcggggcgcttgcggagaaagtggacgctgaacgcatagcaatcgcaaaggctttcgatttaaacgttccgtcggtctgcgaatgggttaagattagttacggcctgtcaccggccacaatttatgaagcggtgcagggtaatcctgtgctgcgcggcattatgggacctaccagccttaacacggtgcacttcagcgaggatgtaagcaccggactggtaccgttatccgaactgggtcgggtggtgaatgtgcctaccccacttatcgatgctgttcttctgttgatcagtgaactgatagacgtggatttcagaaaggaaggtcgtaccttggaaaaattaggtctgagcggacttaccgccgcggaaataagaagtgctgttgag

SEQ ID NO: 664 - protein, 359 aa, Artificial Sequence
  Engineered variant of opine dehydrogenase CENDH
MIESKTYAVLGLGNGGHAFAAYLALKGQRVLAWDIDAQRIKEIQDRGAIIAEGPGLAGTAHPDLLTSDIGVAVKDADVILIVVPAIHHASIAAKIASYISEGQLIILNPGRTGGALEFRKILRENGAPEVTIGETSNMLFTCRSERPGQVTVNAITRAMDFACLPAAKAGWALEQIGSVLPQYQAVENVLHTSLTNIEAVLHPLPTLLNAARCESGTPFHYYTEGITPSVGALAEKVDAERIAIAKAFDLNVPSVCEWVKISYGLSPATIYEAVQGNPVLRGIMGPTSLNTVHFSEDVSTGLVPLSELGRVVNVPTPLIDAVLLLISELIDVDFRKEGRTLEKLGLSGLTAAEIRSAVE

SEQ ID NO: 665 - DNA, 1077 bp, Artificial Sequence
  Engineered variant of opine dehydrogenase CENDH
atgatcgagtcaaaaacatacgccgttttgggattaggaaacgggggtcacgcatttgccgcctatttagcattgaagggccagcgtgtactggcttgggacatcgatgctcagagaatcaaagagattcaggaccgtggagccatcatagcggaaggaccaggacttgctgggactgctcacccggatcttctgacctcagatataggtttggcggttaaagacgctgatgtgatactgattgtagtgccggccatccaccacgcttccattgcagcaaaaatcgccagttacatttccgagggtcagttgattatccttaaccctgggcgtacgggtggagcgctggaattccggaaaatcctgcgtgaaaatggtgcgccggaggtaacgatcggggaaacctcaaacatgctctttacatgccgctccgagagaccaggacaggttacggtaaatgcgataacactggccatggactttgcatgtctcccagcggcaaaagctggatgggccctggaacagatagggtcggttcttcctcaataccaggctgtcgaaaacgtgttgcatacttcgctgactaatatcgaagctgtattgcacccgctgccaacactgttaaacgctgctcgttgtgagtctggtaccccattccattattataccgaggggattacgccatcagtcggggcgcttgcggagaaagtggacgctgaacgcatagcaatcgcaaaggctttcgatttaaacgttccgtcggtctgcgaatgggttaagattagttacggccagaccccggccacaatttatgaagcggtgcagggtaatcctgtgctgcgcggcattatgggacctaccagccttaacacggtgcacttcagcgaggatgtaagcaccggactggtaccgttatccgaactgggtcgggtggtgaatgtgcctaccccacttatcgatgctgttcttctgttgatcagtgaactgatagacgtggatttcagaaaggaaggtcgtaccttggaaaaattaggtctgagcggacttaccgccgcggaaataagaagtgctgttgag

SEQ ID NO: 666 - protein, 359 aa, Artificial Sequence
  Engineered variant of opine dehydrogenase CENDH
MIESKTYAVLGLGNGGHAFAAYLALKGQRVLAWDIDAQRIKEIQDRGAIIAEGPGLAGTAHPDLLTSDIGLAVKDADVILIVVPAIHHASIAAKIASYISEGQLIILNPGRTGGALEFRKILRENGAPEVTIGETSNMLFTCRSERPGQVTVNAITLAMDFACLPAAKAGWALEQIGSVLPQYQAVENVLHTSLTNIEAVLHPLPTLLNAARCESGTPFHYYTEGITPSVGALAEKVDAERIAIAKAFDLNVPSVCEWVKISYGQTPATIYEAVQGNPVLRGIMGPTSLNTVHFSEDVSTGLVPLSELGRVVNVPTPLIDAVLLLISELIDVDFRKEGRTLEKLGLSGLTAAEIRSAVE

SEQ ID NO: 667 - DNA, 1077 bp, Artificial Sequence
  Engineered variant of opine dehydrogenase CENDH
atgatcgagtcaaaaacatacgccgttttgggattaggaaacgggggtcacgcatttgccgcctatttagcattgaagggccagcgtgtactggcttgggacatcgatgctcagagaatcaaagagattcaggaccgtggagccatcatagcggaaggaccaggacttgctgggactgctcacccggatcttctgacctcagatataggtgtggcggttaaagacgctgatgtgatactgattgtagtgccggccatccaccacgcttccattgcagcaaaaatcgccagttacatttccgagggtcagttgattatccttaaccctgggcgtacgggtggagcgctggaattccggaaaatcctgcgtgaaaatggtgcgccggaggtaacgatcggggaaacctcaaacatgctctttacatgccgctccgagagaccaggacaggttacggtaaatgcgataacactggccatggactttgcatgtctcccagcggcaaaagctggatgggccctggaacagatacattcggttcttcctcaataccaggctgtcgaaaacgtgttgcatacttcgctgactaatatcgaagctgtattgcacccgctgccaacactgttaaacgctgctcgttgtgagtctggtaccccattccattattataccgaggggattacgccatcagtcggggcgcttgcggagaaagtggacgctgaacgcatagcaatcgcaaaggctttcgatttaaacgttccgtcggtctgcgaatgggttaagattagttacggccagaccccggccacaatttatgaagcggtgcagggtaatcctgtgctgcgcggcattatgggacctaccagccttaacacggtgcacttcttcgaggatgtaagcaccggactggtaccgttatccgaactgggtcgggtggtgaatgtgcctaccccacttatcgatgctgttcttctgttgatcagtgaactgatagacgtggatttcagaaaggaaggtcgtaccttggaaaaattaggtctgagcggacttaccgccgcggaaataagaagtgctgttgag

SEQ ID NO: 668 - protein, 359 aa, Artificial Sequence
  Engineered variant of opine dehydrogenase CENDH
MIESKTYAVLGLGNGGHAFAAYLALKGQRVLAWDIDAQRIKEIQDRGAIIAEGPGLAGTAHPDLLTSDIGVAVKDADVILIVVPAIHHASIAAKIASYISEGQLIILNPGRTGGALEFRKILRENGAPEVTIGETSNMLFTCRSERPGQVTVNAITLAMDFACLPAAKAGWALEQIHSVLPQYQAVENVLHTSLTNIEAVLHPLPTLLNAARCESGTPFHYYTEGITPSVGALAEKVDAERIAIAKAFDLNVPSVCEWVKISYGQTPATIYEAVQGNPVLRGIMGPTSLNTVHFFEDVSTGLVPLSELGRVVNVPTPLIDAVLLLISELIDVDFRKEGRTLEKLGLSGLTAAEIRSAVE

SEQ ID NO: 669 - DNA, 1077 bp, Artificial Sequence
  Engineered variant of opine dehydrogenase CENDH
atgatcgagtcaaaaacatacgccgttttgggattaggaaacgggggtcacgcatttgccgcctatttagcattgaagggccagcgtgtactggcttgggacatcgatgctcagagaatcaaagagattcaggaccgtggagccatcatagcggaaggaccaggacttgctgggactgctcacccggatcttctgacctcagatataggtgtggcggttaaagacgctgatgtgatactgattgtagtgccggccatccaccacgcttccattgcagcacgtatcgccagttacatttccgagggtcagttgattatccttaaccctgggcgtacgggtggagcgctggaattccggaaaatcctgcgtgaaaatggtgcgccggaggtaacgatcggggaaacctcaaacatgctctttacatgccgctccgagagaccaggacaggttacggtaaatgcgataacactggccatggactttgcatgtctcccagcggcaaaagctggatgggccctggaacagatagggtcggttcttcctcaataccaggctgtcgaaaacgtgttgcatacttcgctgactaatatcgaagctgtattgcacccgctgccaacactgttaaacgctgctcgttgtgagtctggtaccccattccattattataccgaggggattacgccatcagtcggggcgcttgcggagaaagtggacgctgaacgcatagcaatcgcaaaggctttcgatttaaacgttccgtcggtctgcgaatgggttaagattagttacggcctgtcaccggccacaatttatgaagcggtgcagggtaatcctgtgctgcgcggcattatgggacctaccagccttaacacggtgcacttcttcgaggatgtaagcaccggactggtaccgttatccgaactgggtcgggcagtgaatgtgcctaccccacttatcgatgctgttcttctgttgatcagttcgctgatagacgtggatttcagaaaggaaggtcgtaccttggaaaaattaggtctgagcggacttaccgccgcggaaataagaagtgctgttgag

SEQ ID NO: 670 - protein, 359 aa, Artificial Sequence
  Engineered variant of opine dehydrogenase CENDH
MIESKTYAVLGLGNGGHAFAAYLALKGQRVLAWDIDAQRIKEIQDRGAIIAEGPGLAGTAHPDLLTSDIGVAVKDADVILIVVPAIHHASIAARIASYISEGQLIILNPGRTGGALEFRKILRENGAPEVTIGETSNMLFTCRSERPGQVTVNAITLAMDFACLPAAKAGWALEQIGSVLPQYQAVENVLHTSLTNIEAVLHPLPTLLNAARCESGTPFHYYTEGITPSVGALAEKVDAERIAIAKAFDLNVPSVCEWVKISYGLSPATIYEAVQGNPVLRGIMGPTSLNTVHFFEDVSTGLVPLSELGRAVNVPTPLIDAVLLLISSLIDVDFRKEGRTLEKLGLSGLTAAEIRSAVE

SEQ ID NO: 671 - DNA, 1077 bp, Artificial Sequence
  Engineered variant of opine dehydrogenase CENDH
atgatcgagtcaaaaacatacgccgttttgggattaggaaacgggggtcacgcatttgccgcctatttagcattgaagggccagcgtgtactggcttgggacatcgatgctcagagaatcaaagagattcaggaccgtggagccatcatagcggaaggaccaggacttgctgggactgctcacccggatcttctgacctcagatataggtttggcggttaaagacgctgatgtgatactgattgtagtgccggccatccaccacgcttccattgcagcaaaaatcgccagttacatttccgagggtcagttgattatccttaaccctgggcgtacgggtggagcgctggaattccggaaaatcctgcgtgaaaatggtgcgccggaggtaacgatcggggaaacctcaaacatgctctttacatgccgctccgagagaccaggacaggttacggtaaatgcgataacactggccatggactttgcatgtctcccagcggcaaaagctggatgggccctggaacagatacattcggttcttcctcaataccaggctgtcgaaaacgtgttgcatacttcgctgactaatatcgaagctgtattgcacccgctgccaacactgttaaacgctgctcgttgtgagtctggtaccccattccattattataccgaggggattacgccatcagtcggggcgcttgcggagaaagtggacgctgaacgcatagcaatcgcaaaggctttcgatttaaacgttccgtcggtctgcgaatgggttaagattagttacggcctgtcaccggccacaatttatgaagcggtgcagggtaatcctgtgctgcgcggcattatgggacctaccagccttaacacggtgcacttcttcgaggatgtaagcaccggactggtaccgttatccgaactgggtcgggtggtgaatgtgcctaccccacttatcgatgctgttcttctgttgatcagttcgctgatagacgtggatttcagaaaggaaggtcgtaccttggaaaaattaggtctgagcggacttaccgccgcggaaataagaagtgctgttgag

SEQ ID NO: 672 - protein, 359 aa, Artificial Sequence
  Engineered variant of opine dehydrogenase CENDH
MIESKTYAVLGLGNGGHAFAAYLALKGQRVLAWDIDAQRIKEIQDRGAIIAEGPGLAGTAHPDLLTSDIGLAVKDADVILIVVPAIHHASIAAKIASYISEGQLIILNPGRTGGALEFRKILRENGAPEVTIGETSNMLFTCRSERPGQVTVNAITLAMDFACLPAAKAGWALEQIHSVLPQYQAVENVLHTSLTNIEAVLHPLPTLLNAARCESGTPFHYYTEGITPSVGALAEKVDAERIAIAKAFDLNVPSVCEWVKISYGLSPATIYEAVQGNPVLRGIMGPTSLNTVHFFEDVSTGLVPLSELGRVVNVPTPLIDAVLLLISSLIDVDFRKEGRTLEKLGLSGLTAAEIRSAVE

SEQ ID NO: 673 - DNA, 1077 bp, Artificial Sequence
  Engineered variant of opine dehydrogenase CENDH
atgatcgagtcaaaaacatacgccgttttgggattaggaaacgggggtcacgcatttgccgcctatttagcattgaagggccagcgtgtactggcttgggacatcgatgctcagagaatcaaagagattcaggaccgtggagccatcatagcggaaggaccaggacttgctgggactgctcacccggatcttctgacctcagatataggtttggcggttaaagacgctgatgtgatactgattgtagtgccggccatccaccacgcttccattgcagcaaaaatcgccagttacatttccgagggtcagttgattatccttaaccctgggcgtacgggtggagcgctggaattccggaaaatcctgcgtgaaaatggtgcgccggaggtaacgatcggggaaacctcaaacatgctctttacatgccgctccgagagaccaggacaggttacggtaaatgcgataacactggccatggactttgcatgtctcccagcggcaaaagctggatgggccctggaacagatagggtcggttcttcctcaataccaggctgtcgaaaacgtgttgcatacttcgctgactaatatcgaagctgtattgcacccgctgccaacactgttaaacgctgctcgttgtgagtctggtaccccattccattattataccgaggggattacgccatcagtcggggcgcttgcggagaaagtggacgctgaacgcatagcaatcgcaaaggctttcgatttaaacgttccgtcggtctgcgaatgggttaagattagttacggccagtcaccggccacaatttatgaagcggtgcagggtaatcctgtgctgcgcggcattatgggacctaccagccttaacacggtgcacttcttcgaggatgtaagcaccggactggtaccgttatccgaactgggtcggaccgtgaatgtgcctaccccacttatcgatgctgttcttctgttgatcagtgaactgatagacgtggatttcagaaaggaaggtcgtaccttggaaaaattaggtctgagcggacttaccgccgcggaaataagaagtgctgttgag

SEQ ID NO: 674 - protein, 359 aa, Artificial Sequence
  Engineered variant of opine dehydrogenase CENDH
MIESKTYAVLGLGNGGHAFAAYLALKGQRVLAWDIDAQRIKEIQDRGAIIAEGPGLAGTAHPDLLTSDIGLAVKDADVILIVVPAIHHASIAAKIASYISEGQLIILNPGRTGGALEFRKILRENGAPEVTIGETSNMLFTCRSERPGQVTVNAITLAMDFACLPAAKAGWALEQIGSVLPQYQAVENVLHTSLTNIEAVLHPLPTLLNAARCESGTPFHYYTEGITPSVGALAEKVDAERIAIAKAFDLNVPSVCEWVKISYGQSPATIYEAVQGNPVLRGIMGPTSLNTVHFFEDVSTGLVPLSELGRTVNVPTPLIDAVLLLISELIDVDFRKEGRTLEKLGLSGLTAAEIRSAVE

SEQ ID NO: 675 - DNA, 1077 bp, Artificial Sequence
  Engineered variant of opine dehydrogenase CENDH
atgatcgagtcaaaaacatacgccgttttgggattaggaaacgggggtcacgcatttgccgcctatttagcattgaagggccagcgtgtactggcttgggacatcgatgctcagagaatcaaagagattcaggaccgtggagccatcatagcggaaggaccaggacttgctgggactgctcacccggatcttctgacctcagatataggtgtggcggttaaagacgctgatgtgatactgattgtagtgccggccatccaccacgcttccattgcagcaaaaatcgccagttacatttccgagggtcagttgattatccttaaccctgggcgtacgggtggagcgctggaattccggaaaatcctgcgtgaaaatggtgcgccggaggtaacgatcggggaaacctcaaacatgctctttacatgccgctccgagagaccaggacaggttacggtaaatgcgataacacgtgccatggactttgcatgtctcccagcggcaaaagctggatgggccctggaacagatagggtcggttcttcctcaatgccaggctgtcgaaaacgtgttgcatacttcgctgactaatatcgaagctgtattgcacccgctgccaacactgttaaacgctgctcgttgtgagtctggtaccccattccattattataccgaggggattacgccatcagtcggggcgcttgcggagaaagtggacgctgaacgcatagcaatcgcaaaggctttcgatttaaacgttccgtcggtctgcgaatgggttaagattagttacggccagtcaccggccacaatttatgaagcggtgcagggtaatcctgtgctgcgcggcattatgggacctaccagccttaacacggtgcacttcttcgaggatgtaagcaccggactggtaccgttatccgaactgggtcgggtggtgaatgtgcctaccccacttatcgatgctgttcttctgttgatcagtgaactgatagacgtggatttcagaaaggaaggtcgtaccttggaaaaattaggtctgagcggacttaccgccgcggaaataagaagtgctgttgag

SEQ ID NO: 676 - protein, 359 aa, Artificial Sequence
  Engineered variant of opine dehydrogenase CENDH
MIESKTYAVLGLGNGGHAFAAYLALKGQRVLAWDIDAQRIKEIQDRGAIIAEGPGLAGTAHPDLLTSDIGVAVKDADVILIVVPAIHHASIAAKIASYISEGQLIILNPGRTGGALEFRKILRENGAPEVTIGETSNMLFTCRSERPGQVTVNAITRAMDFACLPAAKAGWALEQIGSVLPQCQAVENVLHTSLTNIEAVLHPLPTLLNAARCESGTPFHYYTEGITPSVGALAEKVDAERIAIAKAFDLNVPSVCEWVKISYGQSPATIYEAVQGNPVLRGIMGPTSLNTVHFFEDVSTGLVPLSELGRVVNVPTPLIDAVLLLISELIDVDFRKEGRTLEKLGLSGLTAAEIRSAVE

SEQ ID NO: 677 - DNA, 1077 bp, Artificial Sequence
  Engineered variant of opine dehydrogenase CENDH
atgatcgagtcaaaaacatacgccgttttgggattaggaaacgggggtcacgcatttgccgcctatttagcattgaagggccagcgtgtactggcttgggacatcgatgctcagagaatcaaagagattcaggaccgtggagccatcatagcggaaggaccaggacttgctgggactgctcacccggatcttctgacctcagatataggttgcgcggttaaagacgctgatgtgatactgattgtagtgccggccatccaccacgcttccattgcagcaaaaatcgccagttacatttccgagggtcagttgattatccttaaccctgggcgtacgggtggagcgctggaattccggaaaatcctgcgtgaaaatggtgcgccggaggtaacgatcggggaaacctcaaacatgctctttacatgccgctccgagagaccaggacaggttacggtaaatgcgataacactggccatggactttgcatgtctcccagcggcaaaagctggatgggccctggaacagatacattcggttcttcctcaataccaggctgtcgaaaacgtgttgcatacttcgctgactaatatcgaagctgtattgcacccgctgccaacactgttaaacgctgctcgttgtgagtctggtaccccattccattattataccgaggggattacgccatcagtcggggcgcttgcggagaaagtggacgctgaacgcatagcaatcgcaaaggctttcgatttaaacgttccgtcggtctgcgaatgggttaagattagttacggcctgtcaccggccacaatttatgaagcggtgcagggtaatcctgtgctgcgcggcattatgggacctaccagccttaacacggtgcacttcttcgaggatgtaagcaccggactggtaccgttatccgaactgggtcgggtggtgaatgtgcctaccccacttatcgatgctgttcttctgttgatcagttcgctgatagacgtggatttcagaaaggaaggtcgtaccttggaaaaattaggtctgagcggacttaccgccgcggaaataagaagtgctgttgag

SEQ ID NO: 678 - protein, 359 aa, Artificial Sequence
  Engineered variant of opine dehydrogenase CENDH
MIESKTYAVLGLGNGGHAFAAYLALKGQRVLAWDIDAQRIKEIQDRGAIIAEGPGLAGTAHPDLLTSDIGCAVKDADVILIVVPAIHHASIAAKIASYISEGQLIILNPGRTGGALEFRKILRENGAPEVTIGETSNMLFTCRSERPGQVTVNAITLAMDFACLPAAKAGWALEQIHSVLPQYQAVENVLHTSLTNIEAVLHPLPTLLNAARCESGTPFHYYTEGITPSVGALAEKVDAERIAIAKAFDLNVPSVCEWVKISYGLSPATIYEAVQGNPVLRGIMGPTSLNTVHFFEDVSTGLVPLSELGRVVNVPTPLIDAVLLLISSLIDVDFRKEGRTLEKLGLSGLTAAEIRSAVE

SEQ ID NO: 679 - DNA, 1077 bp, Artificial Sequence
  Engineered variant of opine dehydrogenase CENDH
atgatcgagtcaaaaacatacgccgttttgggattaggaaacgggggtcacgcatttgccgcctatttagcattgaagggccagcgtgtactggcttgggacatcgatgctcagagaatcaaagagattcaggaccgtggagccatcatagcggaaggaccaggacttgctgggactgctcacccggatcttctgacctcagatataggtttggcggttaaagacgctgatgtgatactgattgtagtgccggccatccaccacgcttccattgcagcaaaaatcgccagttacatttccgagggtcagttgattatccttaaccctgggcgtacgggtggagcgctggaattccggaaaatcctgcgtgaaaatggtgcgccggaggtaacgatcggggaaacctcaaacatgctctttacatgccgctccgagagaccaggacaggttacggtaaatgcgataacacgtgccatggactttgcatgtctcccagcggcaaaagctggatgggccctggaacagatacattcggttcttcctcaataccaggctgtcgaaaacgtgttgcatacttcgctgactaatatcgaagctgtattgcacccgctgccaacactgttaaacgctgctcgttgtgagtctggtaccccattccattattataccgaggggattacgccatcagtcggggcgcttgcggagaaagtggacgctgaacgcatagcaatcgcaaaggctttcgatttaaacgttccgtcggtctgcgaatgggttaagattagttacggccagtcaccggccacaatttatgaagcggtgcagggtaatcctgtgctgcgcggcattatgggacctaccagccttaacacggtgcacttcttcgaggatgtaagcaccggactggtaccgttatccgaactgggtcggaccgtgaatgtgcctaccccacttatcgatgctgttcttctgttgatcagtgaactgatagacgtggatttcagaaaggaaggtcgtaccttggaaaaattaggtctgagcggacttaccgccgcggaaataagaagtgctgttgag

SEQ ID NO: 680 - protein, 359 aa, Artificial Sequence
  Engineered variant of opine dehydrogenase CENDH
MIESKTYAVLGLGNGGHAFAAYLALKGQRVLAWDIDAQRIKEIQDRGAIIAEGPGLAGTAHPDLLTSDIGLAVKDADVILIVVPAIHHASIAAKIASYISEGQLIILNPGRTGGALEFRKILRENGAPEVTIGETSNMLFTCRSERPGQVTVNAITRAMDFACLPAAKAGWALEQIHSVLPQYQAVENVLHTSLTNIEAVLHPLPTLLNAARCESGTPFHYYTEGITPSVGALAEKVDAERIAIAKAFDLNVPSVCEWVKISYGQSPATIYEAVQGNPVLRGIMGPTSLNTVHFFEDVSTGLVPLSELGRTVNVPTPLIDAVLLLISELIDVDFRKEGRTLEKLGLSGLTAAEIRSAVE

SEQ ID NO: 681 - DNA, 1077 bp, Artificial Sequence
  Engineered variant of opine dehydrogenase CENDH
atgatcgagtcaaaaacatacgccgttttgggattaggaaacgggggtcacgcatttgccgcctatttagcattgaagggccagcgtgtactggcttgggacatcgatgctcagagaatcaaagagattcaggaccgtggagccatcatagcggaaggaccaggacttgctgggactgctcacccggatcttctgacctcagatataggtttggcggttaaagacgctgatgtgatactgattgtagtgccggccatccaccacgcttccattgcagcaaaaatcgccagttacatttccgagggtcagttgattatccttaaccctgggcgtacgggtggagcgctggaattccggaaaatcctgcgtgaaaatggtgcgccggaggtaacgatcggggaaacctcaaacatgctctttacatgccgctccgagagaccaggacaggttacggtaaatgcgataacacgtgccatggactttgcatgtctcccagcggcaaaagctggatgggccctggaacagatagggtcggttcttcctcaatgccaggctgtcgaaaacgtgttgcatacttcgctgactaatatcgaagctgtattgcacccgctgccaacactgttaaacgctgctcgttgtgagtctggtaccccattccattattataccgaggggattacgccatcagtcggggcgcttgcggagaaagtggacgctgaacgcatagcaatcgcaaaggctttcgatttaaacgttccgtcggtctgcgaatgggttaagattagttacggcctgaccccggccacaatttatgaagcggtgcagggtaatcctgtgctgcgcggcattatgggacctaccagccttaacacggtgcacttcttcgaggatgtaagcaccggactggtaccgttatccgaactgggtcgggtggtgaatgtgcctaccccacttatcgatgctgttcttctgttgatcagttcgctgatagacgtggatttcagaaaggaaggtcgtaccttggaaaaattaggtctgagcggacttaccgccgcggaaataagaagtgctgttgag

SEQ ID NO: 682 - protein, 359 aa, Artificial Sequence
  Engineered variant of opine dehydrogenase CENDH
MIESKTYAVLGLGNGGHAFAAYLALKGQRVLAWDIDAQRIKEIQDRGAIIAEGPGLAGTAHPDLLTSDIGLAVKDADVILIVVPAIHHASIAAKIASYISEGQLIILNPGRTGGALEFRKILRENGAPEVTIGETSNMLFTCRSERPGQVTVNAITRAMDFACLPAAKAGWALEQIGSVLPQCQAVENVLHTSLTNIEAVLHPLPTLLNAARCESGTPFHYYTEGITPSVGALAEKVDAERIAIAKAFDLNVPSVCEWVKISYGLTPATIYEAVQGNPVLRGIMGPTSLNTVHFFEDVSTGLVPLSELGRVVNVPTPLIDAVLLLISSLIDVDFRKEGRTLEKLGLSGLTAAEIRSAVE

SEQ ID NO: 683 - DNA, 1077 bp, Artificial Sequence
  Engineered variant of opine dehydrogenase CENDH
atgatcgagtcaaaaacatacgccgttttgggattaggaaacgggggtcacgcatttgccgcctatttagcattgaagggccagcgtgtactggcttgggacatcgatgctcagagaatcaaagagattcaggaccgtggagccatcatagcggaaggaccaggacttgctgggactgctcacccggatcttctgacctcagatataggtttggcggttaaagacgctgatgtgatactgattgtagtgccggccatccaccacgcttccattgcagcaaaaatcgccagttacatttccgagggtcagttgattatccttaaccctgggcgtacgggtggagcgctggaattccggaaaatcctgcgtgaaaatggtgcgccggaggtaacgatcggggaaacctcaaacatgctctttacatgccgctccgagagaccaggacaggttacggtaaatgcgataacacgtgccatggactttgcatgtctcccagcggcaaaagctggatgggccctggaacagatagggtcggttcttcctcaataccaggctgtcgaaaacgtgttgcatacttcgctgactaatatcgaagctgtattgcacccgctgccaacactgttaaacgctgctcgttgtgagtctggtaccccattccattattataccgaggggattacgccatcagtcggggcgcttgcggagaaagtggacgctgaacgcatagcaatcgcaaaggctttcgatttaaacgttccgtcggtctgcgaatgggttaagattagttacggccagtcaccggccacaatttatgaagcggtgcagggtaatcctgtgctgcgcggcattatgggacctaccagccttaacacggtgcacttcttcgaggatgtaagcaccggactggtaccgttatccgaactgggtcggaccgtgaatgtgcctaccccacttatcgatgctgttcttctgttgatcagttcgctgatagacgtggatttcagaaaggaaggtcgtaccttggaaaaattaggtctgagcggacttaccgccgcggaaataagaagtgctgttgag

SEQ ID NO: 684 - protein, 359 aa, Artificial Sequence
  Engineered variant of opine dehydrogenase CENDH
MIESKTYAVLGLGNGGHAFAAYLALKGQRVLAWDIDAQRIKEIQDRGAIIAEGPGLAGTAHPDLLTSDIGLAVKDADVILIVVPAIHHASIAAKIASYISEGQLIILNPGRTGGALEFRKILRENGAPEVTIGETSNMLFTCRSERPGQVTVNAITRAMDFACLPAAKAGWALEQIGSVLPQYQAVENVLHTSLTNIEAVLHPLPTLLNAARCESGTPFHYYTEGITPSVGALAEKVDAERIAIAKAFDLNVPSVCEWVKISYGQSPATIYEAVQGNPVLRGIMGPTSLNTVHFFEDVSTGLVPLSELGRTVNVPTPLIDAVLLLISSLIDVDFRKEGRTLEKLGLSGLTAAEIRSAVE

SEQ ID NO: 685 - DNA, 1077 bp, Artificial Sequence
  Engineered variant of opine dehydrogenase CENDH
atgatcgagtcaaaaacatacgccgttttgggattaggaaacgggggtcacgcatttgccgcctatttagcattgaagggccagcgtgtactggcttgggacatcgatgctcagagaatcaaagagattcaggaccgtggagccatcatagcggaaggaccaggacttgctgggactgctcacccggatcttctgacctcagatataggttgcgcggttaaagacgctgatgtgatactgattgtagtgccggccatccaccacgcttccattgcagcaaaaatcgccagttacatttccgagggtcagttgattatccttaaccctgggcgtacgggtggagcgctggaattccggaaaatcctgcgtgaaaatggtgcgccggaggtaacgatcggggaaacctcaaacatgctctttacatgccgctccgagagaccaggacaggttacggtaaatgcgataacacgtgccatggactttgcatgtctcccagcggcaaaagctggatgggccctggaacagatagggtcggttcttcctcaataccaggctgtcgaaaacgtgttgcatacttcgctgactaatatcgaagctgtattgcacccgctgccaacactgttaaacgctgctcgttgtgagtctggtaccccattccattattataccgaggggattacgccatcagtcggggcgcttgcggagaaagtggacgctgaacgcatagcaatcgcaaaggctttcgatttaaacgttccgtcggtctgcgaatgggttaagattagttacggcctgtcaccggccacaatttatgaagcggtgcagggtaatcctgtgctgcgcggcattatgggacctaccagccttaacacggtgcacttcttcgaggatgtaagcaccggactggtaccgttatccgaactgggtcgggtggtgaatgtgcctaccccacttatcgatgctgttcttctgttgatcagttcgctgatagacgtggatttcagaaaggaaggtcgtaccttggaaaaattaggtctgagcggacttaccgccgcggaaataagaagtgctgttgag

SEQ ID NO: 686 - protein, 359 aa, Artificial Sequence
  Engineered variant of opine dehydrogenase CENDH
MIESKTYAVLGLGNGGHAFAAYLALKGQRVLAWDIDAQRIKEIQDRGAIIAEGPGLAGTAHPDLLTSDIGCAVKDADVILIVVPAIHHASIAAKIASYISEGQLIILNPGRTGGALEFRKILRENGAPEVTIGETSNMLFTCRSERPGQVTVNAITRAMDFACLPAAKAGWALEQIGSVLPQYQAVENVLHTSLTNIEAVLHPLPTLLNAARCESGTPFHYYTEGITPSVGALAEKVDAERIAIAKAFDLNVPSVCEWVKISYGLSPATIYEAVQGNPVLRGIMGPTSLNTVHFFEDVSTGLVPLSELGRVVNVPTPLIDAVLLLISSLIDVDFRKEGRTLEKLGLSGLTAAEIRSAVE

SEQ ID NO: 687 - DNA, 1077 bp, Artificial Sequence
  Engineered variant of opine dehydrogenase CENDH
atgatcgagtcaaaaacatacgccgttttgggattaggaaacgggggtcacgcatttgccgcctatttagcattgaagggccagcgtgtactggcttgggacatcgatgctcagagaatcaaagagattcaggaccgtggagccatcatagcggaaggaccaggacttgctgggactgctcacccggatcttctgacctcagatataggttgcgcggttaaagacgctgatgtgatactgattgtagtgccggccatccaccacgcttccattgcagcaaaaatcgccagttacatttccgagggtcagttgattatccttaaccctgggcgtacgggtggagcgctggaattccggaaaatcctgcgtgaaaatggtgcgccggaggtaacgatcggggaaacctcaaacatgctctttacatgccgctccgagagaccaggacaggttacggtaaattttataacactggccatggactttgcatgtctcccagcggcaaaagctggatgggccctggaacagatagggtcggttcttcctcaataccaggctgtcgaaaacgtgttgcatacttcgctgactaatatcgaagctgtattgcacccgctgccaacactgttaaacgctgctcgttgtgagtctggtaccccattccattattataccgaggggattacgccatcagtcggggcgcttgcggagaaagtggacgctgaacgcatagcaatcgcaaaggctttcgatttaaacgttccgtcggtctgcgaatgggttaagattagttacggcctgtcaccggccacaatttatgaagcggtgcagggtaatcctgtgctgcgcggcattatgggacctaccagccttaacacggtgcacttcttcgaggatgtaagcaccggactggtaccgttatccgaactgggtcgggtggtgaatgtgcctaccccacttatcgatgctgttcttctgttgatcagtgaactgatagacgtggatttcagaaaggaaggtcgtaccttggaaaaattaggtctgagcggacttaccgccgcggaaataagaagtgctgttgag

SEQ ID NO: 688 - protein, 359 aa, Artificial Sequence
  Engineered variant of opine dehydrogenase CENDH
MIESKTYAVLGLGNGGHAFAAYLALKGQRVLAWDIDAQRIKEIQDRGAIIAEGPGLAGTAHPDLLTSDIGCAVKDADVILIVVPAIHHASIAAKIASYISEGQLIILNPGRTGGALEFRKILRENGAPEVTIGETSNMLFTCRSERPGQVTVNFITLAMDFACLPAAKAGWALEQIGSVLPQYQAVENVLHTSLTNIEAVLHPLPTLLNAARCESGTPFHYYTEGITPSVGALAEKVDAERIAIAKAFDLNVPSVCEWVKISYGLSPATIYEAVQGNPVLRGIMGPTSLNTVHFFEDVSTGLVPLSELGRVVNVPTPLIDAVLLLISELIDVDFRKEGRTLEKLGLSGLTAAEIRSAVE

SEQ ID NO: 689 - DNA, 1077 bp, Artificial Sequence
  Engineered variant of opine dehydrogenase CENDH
atgatcgagtcaaaaacatacgccgttttgggattaggaaacgggggtcacgcatttgccgcctatttagcattgaagggccagcgtgtactggcttgggacatcgatgctcagagaatcaaagagattcaggaccgtggagccatcatagcggaaggaccaggacttgctgggactgctcacccggatcttctgacctcagatataggtttggcggttaaagacgctgatgtgatactgattgtagtgccggccatccaccacgcttccattgcagcaaaaatcgccagttacatttccgagggtcagttgattatccttaaccctgggcgtacgggtggagcgctggaattccggaaaatcctgcgtgaaaatggtgcgccggaggtaacgatcggggaaacctcaaacatgctctttacatgccgctccgagagaccaggacaggttacggtaaatgcgataacactggccatggactttgcatgtctcccagcggcaaaagctggatgggccctggaacagatacattcggttcttcctcaataccaggctgtcgaaaacgtgttgcatacttcgctgactaatatcgaagctgtattgcacccgctgccaacactgttaaacgctgctcgttgtgagtctggtaccccattccattattataccgaggggattacgccatcagtcggggcgcttgcggagaaagtggacgctgaacgcatagcaatcgcaaaggctttcgatttaaacgttccgtcggtctgcgaatgggttaagattagttacggcctgtcaccggccacaatttatgaagcggtgcagggtaatcctgtgctgcgcggcattatgggacctaccagccttaacacggtgcacttcttcgaggatgtaagcaccggactggtaccgttatccgaactgggtcggaccgtgaatgtgcctaccccacttatcgatgctgttcttctgttgatcagttcgctgatagacgtggatttcagaaaggaaggtcgtaccttggaaaaattaggtctgagcggacttaccgccgcggaaataagaagtgctgttgag

SEQ ID NO: 690 - protein, 359 aa, Artificial Sequence
  Engineered variant of opine dehydrogenase CENDH
MIESKTYAVLGLGNGGHAFAAYLALKGQRVLAWDIDAQRIKEIQDRGAIIAEGPGLAGTAHPDLLTSDIGLAVKDADVILIVVPAIHHASIAAKIASYISEGQLIILNPGRTGGALEFRKILRENGAPEVTIGETSNMLFTCRSERPGQVTVNAITLAMDFACLPAAKAGWALEQIHSVLPQYQAVENVLHTSLTNIEAVLHPLPTLLNAARCESGTPFHYYTEGITPSVGALAEKVDAERIAIAKAFDLNVPSVCEWVKISYGLSPATIYEAVQGNPVLRGIMGPTSLNTVHFFEDVSTGLVPLSELGRTVNVPTPLIDAVLLLISSLIDVDFRKEGRTLEKLGLSGLTAAEIRSAVE

SEQ ID NO: 691 - DNA, 1077 bp, Artificial Sequence
  Engineered variant of opine dehydrogenase CENDH
atgatcgagtcaaaaacatacgccgttttgggattaggaaacgggggtcacgcatttgccgcctatttagcattgaagggccagcgtgtactggcttgggacatcgatgctcagagaatcaaagagattcaggaccgtggagccatcatagcggaaggaccaggacttgctgggactgctcacccggatcttctgacctcagatataggtgtggcggttaaagacgctgatgtgatactgattgtagtgccggccatccaccacgcttccattgcagcacgtatcgccagttacatttccgagggtcagttgattatccttaaccctgggcgtacgggtggagcgctggaattccggaaaatcctgcgtgaaaatggtgcgccggaggtaacgatcggggaaacctcaaacatgctctttacatgccgctccgagagaccaggacaggttacggtaaattatataacacgtgccatggactttgcatgtctcccagcggcaaaagctggatgggccctggaacagatagggtcggttcttcctcaataccaggctgtcgaaaacgtgttgcatacttcgctgactaatatcgaagctgtattgcacccgctgccaacactgttaaacgctgctcgttgtgagtctggtaccccattccattattataccgaggggattacgccatcagtcggggcgcttgcggagaaagtggacgctgaacgcatagcaatcgcaaaggctttcgatttaaacgttccgtcggtctgcgaatgggttaagattagttacggccagaccccggccacaatttatgaagcggtgcagggtaatcctgtgctgcgcggcattatgggacctaccagccttaacacggtgcacttcagcgaggatgtaagcaccggactggtaccgttatccgaactgggtcgggtggtgaatgtgcctaccccacttatcgatgctgttcttctgttgatcagttcgctgatagacgtggatttcagaaaggaaggtcgtaccttggaaaaattaggtctgagcggacttaccgccgcggaaataagaagtgctgttgag

SEQ ID NO: 692 - protein, 359 aa, Artificial Sequence
  Engineered variant of opine dehydrogenase CENDH
MIESKTYAVLGLGNGGHAFAAYLALKGQRVLAWDIDAQRIKEIQDRGAIIAEGPGLAGTAHPDLLTSDIGVAVKDADVILIVVPAIHHASIAARIASYISEGQLIILNPGRTGGALEFRKILRENGAPEVTIGETSNMLFTCRSERPGQVTVNYITRAMDFACLPAAKAGWALEQIGSVLPQYQAVENVLHTSLTNIEAVLHPLPTLLNAARCESGTPFHYYTEGITPSVGALAEKVDAERIAIAKAFDLNVPSVCEWVKISYGQTPATIYEAVQGNPVLRGIMGPTSLNTVHFSEDVSTGLVPLSELGRVVNVPTPLIDAVLLLISSLIDVDFRKEGRTLEKLGLSGLTAAEIRSAVE

SEQ ID NO: 693 - DNA, 1077 bp, Artificial Sequence
  Engineered variant of opine dehydrogenase CENDH
atgatcgagtcaaaaacatacgccgttttgggattaggaaacgggggtcacgcatttgccgcctatttagcattgaagggccagcgtgtactggcttgggacatcgatgctcagagaatcaaagagattcaggaccgtggagccatcatagcggaaggaccaggacttgctgggactgctcacccggatcttctgacctcagatataggtttggcggttaaagacgctgatgtgatactgattgtagtgccggccatccaccacgcttccattgcagcaaaaatcgccagttacatttccgagggtcagttgattatccttaaccctgggcgtacgggtggagcgctggaattccggaaaatcctgcgtgaaaatggtgcgccggaggtaacgatcggggaaacctcaaacatgctctttacatgccgctccgagagaccaggacaggttacggtaaatgcgataacacgtgccatggactttgcatgtctcccagcggcaaaagctggatgggccctggaacagatacattcggttcttcctcaataccaggctgtcgaaaacgtgttgcatacttcgctgactaatatcgaagctgtattgcacccgctgccaacactgttaaacgctgctcgttgtgagtctggtaccccattccattattataccgaggggattacgccatcagtcggggcgcttgcggagaaagtggacgctgaacgcatagcaatcgcaaaggctttcgatttaaacgttccgtcggtctgcgaatgggttaagattagttacggccagtcaccggccacaatttatgaagcggtgcagggtaatcctgtgctgcgcggcattatgggacctaccagccttaacacggtgcacttcagcgaggatgtaagcaccggactggtaccgttatccgaactgggtcgggtggtgaatgtgcctaccccacttatcgatgctgttcttctgttgatcagtgaactgatagacgtggatttcagaaaggaaggtcgtaccttggaaaaattaggtctgagcggacttaccgccgcggaaataagaagtgctgttgag

SEQ ID NO: 694 - protein, 359 aa, Artificial Sequence
  Engineered variant of opine dehydrogenase CENDH
MIESKTYAVLGLGNGGHAFAAYLALKGQRVLAWDIDAQRIKEIQDRGAIIAEGPGLAGTAHPDLLTSDIGLAVKDADVILIVVPAIHHASIAAKIASYISEGQLIILNPGRTGGALEFRKILRENGAPEVTIGETSNMLFTCRSERPGQVTVNAITRAMDFACLPAAKAGWALEQIHSVLPQYQAVENVLHTSLTNIEAVLHPLPTLLNAARCESGTPFHYYTEGITPSVGALAEKVDAERIAIAKAFDLNVPSVCEWVKISYGQSPATIYEAVQGNPVLRGIMGPTSLNTVHFSEDVSTGLVPLSELGRVVNVPTPLIDAVLLLISELIDVDFRKEGRTLEKLGLSGLTAAEIRSAVE

SEQ ID NO: 695 - DNA, 1077 bp, Artificial Sequence
  Engineered variant of opine dehydrogenase CENDH
atgatcgagtcaaaaacatacgccgttttgggattaggaaacgggggtcacgcatttgccgcctatttagcattgaagggccagcgtgtactggcttgggacatcgatgctcagagaatcaaagagattcaggaccgtggagccatcatagcggaaggaccaggacttgctgggactgctcacccggatcttctgacctcagatataggtttggcggttaaagacgctgatgtgatactgattgtagtgccggccatccaccacgcttccattgcagcacgtatcgccagttacatttccgagggtcagttgattatccttaaccctgggcgtacgggtggagcgctggaattccggaaaatcctgcgtgaaaatggtgcgccggaggtaacgatcggggaaacctcaaacatgctctttacatgccgctccgagagaccaggacaggttacggtaaatgcgataacactggccatggactttgcatgtctcccagcggcaaaagctggatgggccctggaacagatagggtcggttcttcctcaataccaggctgtcgaaaacgtgttgcatacttcgctgactaatatcgaagctgtattgcacccgctgccaacactgttaaacgctgctcgttgtgagtctggtaccccattccattattataccgaggggattacgccatcagtcggggcgcttgcggagaaagtggacgctgaacgcatagcaatcgcaaaggctttcgatttaaacgttccgtcggtctgcgaatgggttaagattagttacggccagtcaccggccacaatttatgaagcggtgcagggtaatcctgtgctgcgcggcattatgggacctaccagccttaacacggtgcacttcagcgaggatgtaagcaccggactggtaccgttatccgaactgggtcgggtggtgaatgtgcctaccccacttatcgatgctgttcttctgttgatcagttcgctgatagacgtggatttcagaaaggaaggtcgtaccttggaaaaattaggtctgagcggacttaccgccgcggaaataagaagtgctgttgag

SEQ ID NO: 696 - protein, 359 aa, Artificial Sequence
  Engineered variant of opine dehydrogenase CENDH
MIESKTYAVLGLGNGGHAFAAYLALKGQRVLAWDIDAQRIKEIQDRGAIIAEGPGLAGTAHPDLLTSDIGLAVKDADVILIVVPAIHHASIAARIASYISEGQLIILNPGRTGGALEFRKILRENGAPEVTIGETSNMLFTCRSERPGQVTVNAITLAMDFACLPAAKAGWALEQIGSVLPQYQAVENVLHTSLTNIEAVLHPLPTLLNAARCESGTPFHYYTEGITPSVGALAEKVDAERIAIAKAFDLNVPSVCEWVKISYGQSPATIYEAVQGNPVLRGIMGPTSLNTVHFSEDVSTGLVPLSELGRVVNVPTPLIDAVLLLISSLIDVDFRKEGRTLEKLGLSGLTAAEIRSAVE

SEQ ID NO: 697 - DNA, 1077 bp, Artificial Sequence
  Engineered variant of opine dehydrogenase CENDH
atgatcgagtcaaaaacatacgccgttttgggattaggaaacgggggtcacgcatttgccgcctatttagcattgaagggccagcgtgtactggcttgggacatcgatgctcagagaatcaaagagattcaggaccgtggagccatcatagcggaaggaccaggacttgctgggactgctcacccggatcttctgacctcagatataggttgcgcggttaaagacgctgatgtgatactgattgtagtgccggccatccaccacgcttccattgcagcaaaaatcgccagttacatttccgagggtcagttgattatccttaaccctgggcgtacgggtggagcgctggaattccggaaaatcctgcgtgaaaatggtgcgccggaggtaacgatcggggaaacctcaaacatgctctttacatgccgctccgagagaccaggacaggttacggtaaatgcgataacacgtgccatggactttgcatgtctcccagcggcaaaagctggatgggccctggaacagatagggtcggttcttcctcaataccaggctgtcgaaaacgtgttgcatacttcgctgactaatatcgaagctgtattgcacccgctgccaacactgttaaacgctgctcgttgtgagtctggtaccccattccattattataccgaggggattacgccatcagtcggggcgcttgcggagaaagtggacgctgaacgcatagcaatcgcaaaggctttcgatttaaacgttccgtcggtctgcgaatgggttaagattagttacggccagtcaccggccacaatttatgaagcggtgcagggtaatcctgtgctgcgcggcattatgggacctaccagccttaacacggtgcacttcagcgaggatgtaagcaccggactggtaccgttatccgaactgggtcgggtggtgaatgtgcctaccccacttatcgatgctgttcttctgttgatcagttcgctgatagacgtggatttcagaaaggaaggtcgtaccttggaaaaattaggtctgagcggacttaccgccgcggaaataagaagtgctgttgag

SEQ ID NO: 698 - protein, 359 aa, Artificial Sequence
  Engineered variant of opine dehydrogenase CENDH
MIESKTYAVLGLGNGGHAFAAYLALKGQRVLAWDIDAQRIKEIQDRGAIIAEGPGLAGTAHPDLLTSDIGCAVKDADVILIVVPAIHHASIAAKIASYISEGQLIILNPGRTGGALEFRKILRENGAPEVTIGETSNMLFTCRSERPGQVTVNAITRAMDFACLPAAKAGWALEQIGSVLPQYQAVENVLHTSLTNIEAVLHPLPTLLNAARCESGTPFHYYTEGITPSVGALAEKVDAERIAIAKAFDLNVPSVCEWVKISYGQSPATIYEAVQGNPVLRGIMGPTSLNTVHFSEDVSTGLVPLSELGRVVNVPTPLIDAVLLLISSLIDVDFRKEGRTLEKLGLSGLTAAEIRSAVE

SEQ ID NO: 699 - DNA, 1077 bp, Artificial Sequence
  Engineered variant of opine dehydrogenase CENDH
atgatcgagtcaaaaacatacgccgttttgggattaggaaacgggggtcacgcatttgccgcctatttagcattgaagggccagcgtgtactggcttgggacatcgatgctcagagaatcaaagagattcaggaccgtggagccatcatagcggaaggaccaggacttgctgggactgctcacccggatcttctgacctcagatataggtttggcggttaaagacgctgatgtgatactgattgtagtgccggccatccaccacgcttccattgcagcaaaaatcgccagttacatttccgagggtcagttgattatccttaaccctgggcgtacgggtggagcgctggaattccggaaaatcctgcgtgaaaatggtgcgccggaggtaacgatcggggaaacctcaaacatgctctttacatgccgctccgagagaccaggacaggttacggtaaatgcgataacacgtgccatggactttgcatgtctcccagcggcaaaagctggatgggccctggaacagatacattcggttcttcctcaatgccaggctgtcgaaaacgtgttgcatacttcgctgactaatatcgaagctgtattgcacccgctgccaacactgttaaacgctgctcgttgtgagtctggtaccccattccattattataccgaggggattacgccatcagtcggggcgcttgcggagaaagtggacgctgaacgcatagcaatcgcaaaggctttcgatttaaacgttccgtcggtctgcgaatgggttaagattagttacggccagtcaccggccacaatttatgaagcggtgcagggtaatcctgtgctgcgcggcattatgggacctaccagccttaacacggtgcacttcttcgaggatgtaagcaccggactggtaccgttatccgaactgggtcggaccgtgaatgtgcctaccccacttatcgatgctgttcttctgttgatcagtgaactgatagacgtggatttcagaaaggaaggtcgtaccttggaaaaattaggtctgagcggacttaccgccgcggaaataagaagtgctgttgag

SEQ ID NO: 700 - protein, 359 aa, Artificial Sequence
  Engineered variant of opine dehydrogenase CENDH
MIESKTYAVLGLGNGGHAFAAYLALKGQRVLAWDIDAQRIKEIQDRGAIIAEGPGLAGTAHPDLLTSDIGLAVKDADVILIVVPAIHHASIAAKIASYISEGQLIILNPGRTGGALEFRKILRENGAPEVTIGETSNMLFTCRSERPGQVTVNAITRAMDFACLPAAKAGWALEQIHSVLPQCQAVENVLHTSLTNIEAVLHPLPTLLNAARCESGTPFHYYTEGITPSVGALAEKVDAERIAIAKAFDLNVPSVCEWVKISYGQSPATIYEAVQGNPVLRGIMGPTSLNTVHFFEDVSTGLVPLSELGRTVNVPTPLIDAVLLLISELIDVDFRKEGRTLEKLGLSGLTAAEIRSAVE

SEQ ID NO: 701 - DNA, 1077 bp, Artificial Sequence
  Engineered variant of opine dehydrogenase CENDH
atgatcgagtcaaaaacatacgccgttttgggattaggaaacgggggtcacgcatttgccgcctatttagcattgaagggccagcgtgtactggcttgggacatcgatgctcagagaatcaaagagattcaggaccgtggagccatcatagcggaaggaccaggacttgctgggactgctcacccggatcttctgacctcagatataggtgtggcggttaaagacgctgatgtgatactgattgtagtgccggccatccaccacgcttccattgcagcacgtatcgccagttacatttccgagggtcagttgattatccttaaccctgggcgtacgggtggagcgctggaattccggaaaatcctgcgtgaaaatggtgcgccggaggtaacgatcggggaaacctcaaacatgctctttacatgccgctccgagagaccaggacaggttacggtaaatgcgataacactggccatggactttgcatgtctcccagcggcaaaagctggatgggccctggaacagatacattcggttcttcctcaataccaggctgtcgaaaacgtgttgcatacttcgctgactaatatcgaagctgtattgcacccgctgccaacactgttaaacgctgctcgttgtgagtctggtaccccattccattattataccgaggggattacgccatcagtcggggcgcttgcggagaaagtggacgctgaacgcatagcaatcgcaaaggctttcgatttaaacgttccgtcggtctgcgaatgggttaagattagttacggccagaccccggccacaatttatgaagcggtgcagggtaatcctgtgctgcgcggcattatgggacctaccagccttaacacggtgcacttcttcgaggatgtaagcaccggactggtaccgttatccgaactgggtcggaccgtgaatgtgcctaccccacttatcgatgctgttcttctgttgatcagtgcgctgatagacgtggatttcagaaaggaaggtcgtaccttggaaaaattaggtctgagcggacttaccgccgcggaaataagaagtgctgttgag

SEQ ID NO: 702 - protein, 359 aa, Artificial Sequence
  Engineered variant of opine dehydrogenase CENDH
MIESKTYAVLGLGNGGHAFAAYLALKGQRVLAWDIDAQRIKEIQDRGAIIAEGPGLAGTAHPDLLTSDIGVAVKDADVILIVVPAIHHASIAARIASYISEGQLIILNPGRTGGALEFRKILRENGAPEVTIGETSNMLFTCRSERPGQVTVNAITLAMDFACLPAAKAGWALEQIHSVLPQYQAVENVLHTSLTNIEAVLHPLPTLLNAARCESGTPFHYYTEGITPSVGALAEKVDAERIAIAKAFDLNVPSVCEWVKISYGQTPATIYEAVQGNPVLRGIMGPTSLNTVHFFEDVSTGLVPLSELGRTVNVPTPLIDAVLLLISALIDVDFRKEGRTLEKLGLSGLTAAEIRSAVE

SEQ ID NO: 703 - DNA, 1077 bp, Artificial Sequence
  Engineered variant of opine dehydrogenase CENDH
atgatcgagtcaaaaacatacgccgttttgggattaggaaacgggggtcacgcatttgccgcctatttagcattgaagggccagcgtgtactggcttgggacatcgatgctcagagaatcaaagagattcaggaccgtggagccatcatagcggaaggaccaggacttgctgggactgctcacccggatcttctgacctcagatataggttgcgcggttaaagacgctgatgtgatactgattgtagtgccggccatccaccacgcttccattgcagcaaaaatcgccagttacatttccgagggtcagttgattatccttaaccctgggcgtacgggtggagcgctggaattccggaaaatcctgcgtgaaaatggtgcgccggaggtaacgatcggggaaacctcaaacatgctctttacatgccgctccgagagaccaggacaggttacggtaaatgcgataacacgtgccatggactttgcatgtctcccagcggcaaaagctggatgggccctggaacagatagggtcggttcttcctcaatgccaggctgtcgaaaacgtgttgcatacttcgctgactaatatcgaagctgtattgcacccgctgccaacactgttaaacgctgctcgttgtgagtctggtaccccattccattattataccgaggggattacgccatcagtcggggcgcttgcggagaaagtggacgctgaacgcatagcaatcgcaaaggctttcgatttaaacgttccgtcggtctgcgaatgggttaagattagttacggccagaccccggccacaatttatgaagcggtgcagggtaatcctgtgctgcgcggcattatgggacctaccagccttaacacggtgcacttcagcgaggatgtaagcaccggactggtaccgttatccgaactgggtcgggtggtgaatgtgcctaccccacttatcgatgctgttcttctgttgatcagttcgctgatagacgtggatttcagaaaggaaggtcgtaccttggaaaaattaggtctgagcggacttaccgccgcggaaataagaagtgctgttgag

SEQ ID NO: 704 - protein, 359 aa, Artificial Sequence
  Engineered variant of opine dehydrogenase CENDH
MIESKTYAVLGLGNGGHAFAAYLALKGQRVLAWDIDAQRIKEIQDRGAIIAEGPGLAGTAHPDLLTSDIGCAVKDADVILIVVPAIHHASIAAKIASYISEGQLIILNPGRTGGALEFRKILRENGAPEVTIGETSNMLFTCRSERPGQVTVNAITRAMDFACLPAAKAGWALEQIGSVLPQCQAVENVLHTSLTNIEAVLHPLPTLLNAARCESGTPFHYYTEGITPSVGALAEKVDAERIAIAKAFDLNVPSVCEWVKISYGQTPATIYEAVQGNPVLRGIMGPTSLNTVHFSEDVSTGLVPLSELGRVVNVPTPLIDAVLLLISSLIDVDFRKEGRTLEKLGLSGLTAAEIRSAVE

SEQ ID NO: 705 - DNA, 1077 bp, Artificial Sequence
  Engineered variant of opine dehydrogenase CENDH
atgatcgagtcaaaaacatacgccgttttgggattaggaaacgggggtcacgcatttgccgcctatttagcattgaagggccagcgtgtactggcttgggacatcgatgctcagagaatcaaagagattcaggaccgtggagccatcatagcggaaggaccaggacttgctgggactgctcacccggatcttctgacctcagatataggtgtggcggttaaagacgctgatgtgatactgattgtagtgccggccatccaccacgcttccattgcagcacgtatcgccagttacatttccgagggtcagttgattatccttaaccctgggcgtacgggtggagcgctggaattccggaaaatcctgcgtgaaaatggtgcgccggaggtaacgatcggggaaacctcaaacatgctctttacatgccgctccgagagaccaggacaggttacggtaaatgcgataacactggccatggactttgcatgtctcccagcggcaaaagctggatgggccctggaacagatagggtcggttcttcctcaataccaggctgtcgaaaacgtgttgcatacttcgctgactaatatcgaagctgtattgcacccgctgccaacactgttaaacgctgctcgttgtgagtctggtaccccattccattattataccgaggggattacgccatcagtcggggcgcttgcggagaaagtggacgctgaacgcatagcaatcgcaaaggctttcgatttaaacgttccgtcggtctgcgaatgggttaagattagttacggccagtcaccggccacaatttatgaagcggtgcagggtaatcctgtgctgcgcggcattatgggacctaccagccttaacacggtgcacttcttcgaggatgtaagcaccggactggtaccgttatccgaactgggtcgggtggtgaatgtgcctaccccacttatcgatgctgttcttctgttgatcagtgaactgatagacgtggatttcagaaaggaaggtcgtaccttggaaaaattaggtctgagcggacttaccgccgcggaaataagaagtgctgttgag

SEQ ID NO: 706 - protein, 359 aa, Artificial Sequence
  Engineered variant of opine dehydrogenase CENDH
MIESKTYAVLGLGNGGHAFAAYLALKGQRVLAWDIDAQRIKEIQDRGAIIAEGPGLAGTAHPDLLTSDIGVAVKDADVILIVVPAIHHASIAARIASYISEGQLIILNPGRTGGALEFRKILRENGAPEVTIGETSNMLFTCRSERPGQVTVNAITLAMDFACLPAAKAGWALEQIGSVLPQYQAVENVLHTSLTNIEAVLHPLPTLLNAARCESGTPFHYYTEGITPSVGALAEKVDAERIAIAKAFDLNVPSVCEWVKISYGQSPATIYEAVQGNPVLRGIMGPTSLNTVHFFEDVSTGLVPLSELGRVVNVPTPLIDAVLLLISELIDVDFRKEGRTLEKLGLSGLTAAEIRSAVE

SEQ ID NO: 707 - DNA, 1077 bp, Artificial Sequence
  Engineered variant of opine dehydrogenase CENDH
atgatcgagtcaaaaacatacgccgttttgggattaggaaacgggggtcacgcatttgccgcctatttagcattgaagggccagcgtgtactggcttgggacatcgatgctcagagaatcaaagagattcaggaccgtggagccatcatagcggaaggaccaggacttgctgggactgctcacccggatcttctgacctcagatataggtttggcggttaaagacgctgatgtgatactgattgtagtgccggccatccaccacgcttccattgcagcaaaaatcgccagttacatttccgagggtcagttgattatccttaaccctgggcgtacgggtggagcgctggaattccggaaaatcctgcgtgaaaatggtgcgccggaggtaacgatcggggaaacctcaaacatgctctttacatgccgctccgagagaccaggacaggttacggtaaatgcgataacactggccatggactttgcatgtctcccagcggcaaaagctggatgggccctggaacagatacattcggttcttcctcaataccaggctgtcgaaaacgtgttgcatacttcgctgactaatatcgaagctgtattgcacccgctgccaacactgttaaacgctgctcgttgtgagtctggtaccccattccattattataccgaggggattacgccatcagtcggggcgcttgcggagaaagtggacgctgaacgcatagcaatcgcaaaggctttcgatttaaacgttccgtcggtctgcgaatgggttaagattagttacggccagtcaccggccacaatttatgaagcggtgcagggtaatcctgtgctgcgcggcattatgggacctaccagccttaacacggtgcacttcagcgaggatgtaagcaccggactggtaccgttatccgaactgggtcggaccgtgaatgtgcctaccccacttatcgatgctgttcttctgttgatcagtgcgctgatagacgtggatttcagaaaggaaggtcgtaccttggaaaaattaggtctgagcggacttaccgccgcggaaataagaagtgctgttgag

SEQ ID NO: 708 - protein, 359 aa, Artificial Sequence
  Engineered variant of opine dehydrogenase CENDH
MIESKTYAVLGLGNGGHAFAAYLALKGQRVLAWDIDAQRIKEIQDRGAIIAEGPGLAGTAHPDLLTSDIGLAVKDADVILIVVPAIHHASIAAKIASYISEGQLIILNPGRTGGALEFRKILRENGAPEVTIGETSNMLFTCRSERPGQVTVNAITLAMDFACLPAAKAGWALEQIHSVLPQYQAVENVLHTSLTNIEAVLHPLPTLLNAARCESGTPFHYYTEGITPSVGALAEKVDAERIAIAKAFDLNVPSVCEWVKISYGQSPATIYEAVQGNPVLRGIMGPTSLNTVHFSEDVSTGLVPLSELGRTVNVPTPLIDAVLLLISALIDVDFRKEGRTLEKLGLSGLTAAEIRSAVE

SEQ ID NO: 709 - DNA, 1077 bp, Artificial Sequence
  Engineered variant of opine dehydrogenase CENDH
atgatcgagtcaaaaacatacgccgttttgggattaggaaacgggggtcacgcatttgccgcctatttagcattgaagggccagcgtgtactggcttgggacatcgatgctcagagaatcaaagagattcaggaccgtggagccatcatagcggaaggaccaggacttgctgggactgctcacccggatcttctgacctcagatataggtgtggcggttaaagacgctgatgtgatactgattgtagtgccggccatccaccacgcttccattgcagcaaaaatcgccagttacatttccgagggtcagttgattatccttaaccctgggcgtacgggtggagcgctggaattccggaaaatcctgcgtgaaaatggtgcgccggaggtaacgatcggggaaacctcaaacatgctctttacatgccgctccgagagaccaggacaggttacggtaaatgcgataacacgtgccatggactttgcatgtctcccagcggcaaaagctggatgggccctggaacagatagggtcggttcttcctcaataccaggctgtcgaaaacgtgttgcatacttcgctgactaatatcgaagctgtattgcacccgctgccaacactgttaaacgctgctcgttgtgagtctggtaccccattccattattataccgaggggattacgccatcagtcggggcgcttgcggagaaagtggacgctgaacgcatagcaatcgcaaaggctttcgatttaaacgttccgtcggtctgcgaatgggttaagattagttacggcctgaccccggccacaatttatgaagcggtgcagggtaatcctgtgctgcgcggcattatgggacctaccagccttaacacggtgcacttcttcgaggatgtaagcaccggactggtaccgttatccgaactgggtcgggtggtgaatgtgcctaccccacttatcgatgctgttcttctgttgatcagtgaactgatagacgtggatttcagaaaggaaggtcgtaccttggaaaaattaggtctgagcggacttaccgccgcggaaataagaagtgctgttgag

SEQ ID NO: 710 - protein, 359 aa, Artificial Sequence
  Engineered variant of opine dehydrogenase CENDH
MIESKTYAVLGLGNGGHAFAAYLALKGQRVLAWDIDAQRIKEIQDRGAIIAEGPGLAGTAHPDLLTSDIGVAVKDADVILIVVPAIHHASIAAKIASYISEGQLIILNPGRTGGALEFRKILRENGAPEVTIGETSNMLFTCRSERPGQVTVNAITRAMDFACLPAAKAGWALEQIGSVLPQYQAVENVLHTSLTNIEAVLHPLPTLLNAARCESGTPFHYYTEGITPSVGALAEKVDAERIAIAKAFDLNVPSVCEWVKISYGLTPATIYEAVQGNPVLRGIMGPTSLNTVHFFEDVSTGLVPLSELGRVVNVPTPLIDAVLLLISELIDVDFRKEGRTLEKLGLSGLTAAEIRSAVE

SEQ ID NO: 711 - DNA, 1077 bp, Artificial Sequence
  Engineered variant of opine dehydrogenase CENDH
atgatcgagtcaaaaacatacgccgttttgggattaggaaacgggggtcacgcatttgccgcctatttagcattgaagggccagcgtgtactggcttgggacatcgatgctcagagaatcaaagagattcaggaccgtggagccatcatagcggaaggaccaggacttgctgggactgctcacccggatcttctgacctcagatataggtgtggcggttaaagacgctgatgtgatactgattgtagtgccggccatccaccacgcttccattgcagcaaaaatcgccagttacatttccgagggtcagttgattatccttaaccctgggcgtacgggtggagcgctggaattccggaaaatcctgcgtgaaaatggtgcgccggaggtaacgatcggggaaacctcaaacatgctctttacatgccgctccgagagaccaggacaggttacggtaaattatataacacgtgccatggactttgcatgtctcccagcggcaaaagctggatgggccctggaacagatacattcggttcttcctcaataccaggctgtcgaaaacgtgttgcatacttcgctgactaatatcgaagctgtattgcacccgctgccaacactgttaaacgctgctcgttgtgagtctggtaccccattccattattataccgaggggattacgccatcagtcggggcgcttgcggagaaagtggacgctgaacgcatagcaatcgcaaaggctttcgatttaaacgttccgtcggtctgcgaatgggttaagattagttacggccagtcaccggccacaatttatgaagcggtgcagggtaatcctgtgctgcgcggcattatgggacctaccagccttaacacggtgcacttcttcgaggatgtaagcaccggactggtaccgttatccgaactgggtcggaccgtgaatgtgcctaccccacttatcgatgctgttcttctgttgatcagttcgctgatagacgtggatttcagaaaggaaggtcgtaccttggaaaaattaggtctgagcggacttaccgccgcggaaataagaagtgctgttgag

SEQ ID NO: 712 - protein, 359 aa, Artificial Sequence
  Engineered variant of opine dehydrogenase CENDH
MIESKTYAVLGLGNGGHAFAAYLALKGQRVLAWDIDAQRIKEIQDRGAIIAEGPGLAGTAHPDLLTSDIGVAVKDADVILIVVPAIHHASIAAKIASYISEGQLIILNPGRTGGALEFRKILRENGAPEVTIGETSNMLFTCRSERPGQVTVNYITRAMDFACLPAAKAGWALEQIHSVLPQYQAVENVLHTSLTNIEAVLHPLPTLLNAARCESGTPFHYYTEGITPSVGALAEKVDAERIAIAKAFDLNVPSVCEWVKISYGQSPATIYEAVQGNPVLRGIMGPTSLNTVHFFEDVSTGLVPLSELGRTVNVPTPLIDAVLLLISSLIDVDFRKEGRTLEKLGLSGLTAAEIRSAVE

SEQ ID NO: 713 - DNA, 1077 bp, Artificial Sequence
  Engineered variant of opine dehydrogenase CENDH
atgatcgagtcaaaaacatacgccgttttgggattaggaaacgggggtcacgcatttgccgcctatttagcattgaagggccagcgtgtactggcttgggacatcgatgctcagagaatcaaagagattcaggaccgtggagccatcatagcggaaggaccaggacttgctgggactgctcacccggatcttctgacctcagatataggtgtggcggttaaagacgctgatgtgatactgattgtagtgccggccatccaccacgcttccattgcagcaaccatcgccagttacatttccgagggtcagttgattatccttaaccctgggcgtacgggtggagcgctggaattccggaaaatcctgcgtgaaaatggtgcgccggaggtaacgatcggggaaacctcaaacatgctctttacatgccgctccgagagaccaggacaggttacggtaaatgcgataacacgtgccatggactttgcatgtctcccagcggcaaaagctggatgggccctggaacagatacattcggttcttcctcaataccaggctgtcgaaaacgtgttgcatacttcgctgactaatatcgaagctgtattgcacccgctgccaacactgttaaacgctgctcgttgtgagtctggtaccccattccattattataccgaggggattacgccatcagtcggggcgcttgcggagaaagtggacgctgaacgcatagcaatcgcaaaggctttcgatttaaacgttccgtcggtctgcgaatgggttaagattagttacggccagtcaccggccacaatttatgaagcggtgcagggtaatcctgtgctgcgcggcattatgggacctaccagccttaacacggtgcacttcagcgaggatgtaagcaccggactggtaccgttatccgaactgggtcgggtggtgaatgtgcctaccccacttatcgatgctgttcttctgttgatcagtgaactgatagacgtggatttcagaaaggaaggtcgtaccttggaaaaattaggtctgagcggacttaccgccgcggaaataagaagtgctgttgag

SEQ ID NO: 714 - protein, 359 aa, Artificial Sequence
  Engineered variant of opine dehydrogenase CENDH
MIESKTYAVLGLGNGGHAFAAYLALKGQRVLAWDIDAQRIKEIQDRGAIIAEGPGLAGTAHPDLLTSDIGVAVKDADVILIVVPAIHHASIAATIASYISEGQLIILNPGRTGGALEFRKILRENGAPEVTIGETSNMLFTCRSERPGQVTVNAITRAMDFACLPAAKAGWALEQIHSVLPQYQAVENVLHTSLTNIEAVLHPLPTLLNAARCESGTPFHYYTEGITPSVGALAEKVDAERIAIAKAFDLNVPSVCEWVKISYGQSPATIYEAVQGNPVLRGIMGPTSLNTVHFSEDVSTGLVPLSELGRVVNVPTPLIDAVLLLISELIDVDFRKEGRTLEKLGLSGLTAAEIRSAVE

SEQ ID NO: 715 - DNA, 1077 bp, Artificial Sequence
  Engineered variant of opine dehydrogenase CENDH
atgatcgagtcaaaaacatacgccgttttgggattaggaaacgggggtcacgcatttgccgcctatttagcattgaagggccagcgtgtactggcttgggacatcgatgctcagagaatcaaagagattcaggaccgtggagccatcatagcggaaggaccaggacttgctgggactgctcacccggatcttctgacctcagatataggtttggcggttaaagacgctgatgtgatactgattgtagtgccggccatccaccacgcttccattgcagcacgtatcgccagttacatttccgagggtcagttgattatccttaaccctgggcgtacgggtggagcgctggaattccggaaaatcctgcgtgaaaatggtgcgccggaggtaacgatcggggaaacctcaaacatgctctttacatgccgctccgagagaccaggacaggttacggtaaatgcgataacactggccatggactttgcatgtctcccagcggcaaaagctggatgggccctggaacagatagggtcggttcttcctcaatgccaggctgtcgaaaacgtgttgcatacttcgctgactaatatcgaagctgtattgcacccgctgccaacactgttaaacgctgctcgttgtgagtctggtaccccattccattattataccgaggggattacgccatcagtcggggcgcttgcggagaaagtggacgctgaacgcatagcaatcgcaaaggctttcgatttaaacgttccgtcggtctgcgaatgggttaagattagttacggcctgtcaccggccacaatttatgaagcggtgcagggtaatcctgtgctgcgcggcattatgggacctaccagccttaacacggtgcacttcttcgaggatgtaagcaccggactggtaccgttatccgaactgggtcgggtggtgaatgtgcctaccccacttatcgatgctgttcttctgttgatcagtgcgctgatagacgtggatttcagaaaggaaggtcgtaccttggaaaaattaggtctgagcggacttaccgccgcggaaataagaagtgctgttgag

SEQ ID NO: 716 - protein, 359 aa, Artificial Sequence
  Engineered variant of opine dehydrogenase CENDH
MIESKTYAVLGLGNGGHAFAAYLALKGQRVLAWDIDAQRIKEIQDRGAIIAEGPGLAGTAHPDLLTSDIGLAVKDADVILIVVPAIHHASIAARIASYISEGQLIILNPGRTGGALEFRKILRENGAPEVTIGETSNMLFTCRSERPGQVTVNAITLAMDFACLPAAKAGWALEQIGSVLPQCQAVENVLHTSLTNIEAVLHPLPTLLNAARCESGTPFHYYTEGITPSVGALAEKVDAERIAIAKAFDLNVPSVCEWVKISYGLSPATIYEAVQGNPVLRGIMGPTSLNTVHFFEDVSTGLVPLSELGRVVNVPTPLIDAVLLLISALIDVDFRKEGRTLEKLGLSGLTAAEIRSAVE

SEQ ID NO: 717 - DNA, 1077 bp, Artificial Sequence; identical to SEQ ID NO: 597
  Engineered variant of opine dehydrogenase CENDH

SEQ ID NO: 718 - protein, 359 aa, Artificial Sequence; identical to SEQ ID NO: 598
  Engineered variant of opine dehydrogenase CENDH

SEQ ID NO: 719 - DNA, 1077 bp, Artificial Sequence
  Engineered variant of opine dehydrogenase CENDH
atgatcgagtcaaaaacatacgccgttttgggattaggaaacgggggtcacgcatttgccgcctatttagcattgaagggccagcgtgtactggcttgggacatcgatgctcagagaatcaaagagattcaggaccgtggagccatcatagcggaaggaccaggacttgctgggactgctcacccggatcttctgacctcagatataggtttggcggttaaagacgctgatgtgatactgattgtagtgccggccatccaccacgcttccattgcagcaaaaatcgccagttacatttccgagggtcagttgattatccttaaccctgggcgtacgggtggagcgctggaattccggaaaatcctgcgtgaaaatggtgcgccggaggtaacgatcggggaaacctcaaacatgctctttacatgccgctccgagagaccaggacaggttacggtaaatgcgataacacgtgccatggactttgcatgtctcccagcggcaaaagctggatgggccctggaacagatagggtcggttcttcctcaataccaggctgtcgaaaacgtgttgcatacttcgctgactaatatcgaagctgtattgcacccgctgccaacactgttaaacgctgctcgttgtgagtctggtaccccattccattattataccgaggggattacgccatcagtcggggcgcttgcggagaaagtggacgctgaacgcatagcaatcgcaaaggctttcgatttaaacgttccgtcggtctgcgaatgggttaagattagttacggccagtcaccggccacaatttatgaagcggtgcagggtattcctgtgctgcgcggcattatgggacctaccagccttaacacggtgcacttcttcgaggatgtaagcaccggactggtaccgttatccgaactgggtcgggcagtgaatgtgcctaccccacttatcgatgctgttcttctgttgatcagttcgctgatagacgtggatttcagaaaggaaggtcgtaccttggaaaaattaggtctgagcggacttaccgccgcggaaataagaagtgctgttgag

SEQ ID NO: 720 - protein, 359 aa, Artificial Sequence
  Engineered variant of opine dehydrogenase CENDH
MIESKTYAVLGLGNGGHAFAAYLALKGQRVLAWDIDAQRIKEIQDRGAIIAEGPGLAGTAHPDLLTSDIGLAVKDADVILIVVPAIHHASIAAKIASYISEGQLIILNPGRTGGALEFRKILRENGAPEVTIGETSNMLFTCRSERPGQVTVNAITRAMDFACLPAAKAGWALEQIGSVLPQYQAVENVLHTSLTNIEAVLHPLPTLLNAARCESGTPFHYYTEGITPSVGALAEKVDAERIAIAKAFDLNVPSVCEWVKISYGQSPATIYEAVQGIPVLRGIMGPTSLNTVHFFEDVSTGLVPLSELGRAVNVPTPLIDAVLLLISSLIDVDFRKEGRTLEKLGLSGLTAAEIRSAVE

SEQ ID NO: 721 - DNA, 1077 bp, Artificial Sequence
  Engineered variant of opine dehydrogenase CENDH
atgatcgagtcaaaaacatacgccgttttgggattaggaaacgggggtcacgcatttgccgcctatttagcattgaagggccagcgtgtactggcttgggacatcgatgctcagagaatcaaagagattcaggaccgtggagccatcatagcggaaggaccaggacttgctgggactgctcacccggatcttctgacctcagatataggtttggcggttaaagacgctgatgtgatactgattgtagtgccggccatccaccacgcttccattgcagcaaaaatcgccagttacatttccgagggtcagttgattatccttaaccctgggcgtacgggtggagcgctggaattccggaaaatcctgcgtgaaaatggtgcgccggaggtaacgatcggggaaacctcaaacatgctctttacatgccgctccgagagaccaggacaggttacggtaaatgcgataacacgtgccatggactttgcatgtctcccagcggcaaaagctggatgggccctggaacagatagggtcggttcttcctcaataccaggctgtcgaaaacgtgttgcatacttcgctgactaatatcgaagctgtattgcacccgctgccaacactgttaaacgctgctcgttgtgagtctggtaccccattccattattataccgaggggattacgccatcagtcggggcgcttgcggagaaagtggacgctgaacgcatagcaatcgcaaaggctttcgatttaaacgttccgtcggtctgcgaatgggttaagattagttacggccagtcaccggccacaatttatgaatgggtgcagggtaatcctgtgctgcgcggcattatgggacctaccagccttaacacggtgcacttcttcgaggatgtaagcaccggactggtaccgttatccgaactgggtcgggcagtgaatgtgcctaccccacttatcgatgctgttcttctgttggtcagttcgctgatagacgtggatttcagaaaggaaggtcgtaccttggaaaaattaggtctgagcggacttaccgccgcggaaataagaagtgctgttgag

SEQ ID NO: 722 - protein, 359 aa, Artificial Sequence
  Engineered variant of opine dehydrogenase CENDH
MIESKTYAVLGLGNGGHAFAAYLALKGQRVLAWDIDAQRIKEIQDRGAIIAEGPGLAGTAHPDLLTSDIGLAVKDADVILIVVPAIHHASIAAKIASYISEGQLIILNPGRTGGALEFRKILRENGAPEVTIGETSNMLFTCRSERPGQVTVNAITRAMDFACLPAAKAGWALEQIGSVLPQYQAVENVLHTSLTNIEAVLHPLPTLLNAARCESGTPFHYYTEGITPSVGALAEKVDAERIAIAKAFDLNVPSVCEWVKISYGQSPATIYEWVQGNPVLRGIMGPTSLNTVHFFEDVSTGLVPLSELGRAVNVPTPLIDAVLLLVSSLIDVDFRKEGRTLEKLGLSGLTAAEIRSAVE

SEQ ID NO: 723 - DNA, 1077 bp, Artificial Sequence
  Engineered variant of opine dehydrogenase CENDH
atgatcgagtcaaaaacatacgccgttttgggattaggaaacgggggtcacgcatttgccgcctatttagcattgaagggccagcgtgtactggcttgggacatcgatgctcagagaatcaaagagattcaggaccgtggagccatcatagcggaaggaccaggacttgctgggactgctcacccggatcttctgacctcagatataggtttggcggttaaagacgctgatgtgatactgattgtagtgccggccatccaccacgcttccattgcagcaaaaatcgccagttacatttccgagggtcagttgattatccttaaccctgggcgtacgggtggagcgctggaattccggaaaatcctgcgtgaaaatggtgcgccggaggtaacgatcggggaaacctcaaacatgctctttacatgccgctccgagagaccaggacaggttacggtaaatgcgataacacgtgccatggactttgcatgtctcccagcggcaaaagctggatgggccctggaacagatagggtcggttcttcctcaataccaggctgtcgaaaacgtgttgcatacttcgctgactaatatcgaagctgtattgcacccgctgccaacactgttaaacgctgctcgttgtgagtctggtaccccattccattattataccgaggggattacgccatcagtcggggcgcttgcggagaaagtggacgctgaacgcatagcaatcgcaaaggctttcgatttaaacgttccgtcggtctgcgaatgggttaagattagttacggccagtcaccggccacaatttatgaagcggtgcagggtgcacctgtgctgcgcggcattatgggacctaccagccttaacacggtgcacttcttcgaggatgtaagcaccggactggtaccgttatccgaactgggtcgggcagtgaatgtgcctaccccacttatcgatgctgttcttctgttgatcagttcgctgatagacgtggatttcagaaaggaaggtcgtaccttggaaaaattaggtctgagcggacttaccgccgcggaaataagaagtgctgttgag

SEQ ID NO: 724 - protein, 359 aa, Artificial Sequence
  Engineered variant of opine dehydrogenase CENDH
MIESKTYAVLGLGNGGHAFAAYLALKGQRVLAWDIDAQRIKEIQDRGAIIAEGPGLAGTAHPDLLTSDIGLAVKDADVILIVVPAIHHASIAAKIASYISEGQLIILNPGRTGGALEFRKILRENGAPEVTIGETSNMLFTCRSERPGQVTVNAITRAMDFACLPAAKAGWALEQIGSVLPQYQAVENVLHTSLTNIEAVLHPLPTLLNAARCESGTPFHYYTEGITPSVGALAEKVDAERIAIAKAFDLNVPSVCEWVKISYGQSPATIYEAVQGAPVLRGIMGPTSLNTVHFFEDVSTGLVPLSELGRAVNVPTPLIDAVLLLISSLIDVDFRKEGRTLEKLGLSGLTAAEIRSAVE

SEQ ID NO: 725 - DNA, 1077 bp, Artificial Sequence
  Engineered variant of opine dehydrogenase CENDH
atgatcgagtcaaaaacatacgccgttttgggattaggaaacgggggtcacgcatttgccgcctatttagcattgaagggccagcgtgtactggcttgggacatcgatgctcagagaatcaaagagattcaggaccgtggagccatcatagcggaaggaccaggacttgctgggactgctcacccggatcttctgacctcagatataggtttggcggttaaagacgctgatgtgatactgattgtagtgccggccatccaccacgcttccattgcagcaaaaatcgccagttacatttccgagggtcagttgattatccttaaccctgggcgtacgggtggagcgctggaattccggaaaatcctgcgtgaaaatggtgcgccggaggtaacgatcggggaaacctcaaacatgctctttacatgccgctccgagagaccaggacaggttacggtaaatgcgataacacgtgccatggactttgcatgtctcccagcggcaaaagctggatgggccctggaacagatagggtcggttcttcctcaataccaggctgtcgaaaacgtgttgcatacttcgctgactaatatcgaagctgtattgcacccgctgccaacactgttaaacgctgctcgttgtgagtctggtaccccattccattattataccgaggggattacgccatcagtcggggcgcttgcggagaaagtggacgctgaacgcatagcaatcgcaaaggctttcgatttaaacgttccgtcggtctgcgaatgggttaagattagttacggccagtcaccggccacaatttatgaatgggtgcagggtaatcctgtgctgcgcggcattatgggacctaccagccttaacacggtgcacttcttcgaggatgtaagcaccggactggtaccgttatccgaactgggtcgggcagtgaatgtgcctaccccacttatcgatgctgttcttctgttgatcagttcgctgatagacgtggatttcagaaaggaaggtcgtaccttggaaaaattaggtctgagcggacttaccgccgcggaaataagaagtgctgttgag

SEQ ID NO: 726 - protein, 359 aa, Artificial Sequence
  Engineered variant of opine dehydrogenase CENDH
MIESKTYAVLGLGNGGHAFAAYLALKGQRVLAWDIDAQRIKEIQDRGAIIAEGPGLAGTAHPDLLTSDIGLAVKDADVILIVVPAIHHASIAAKIASYISEGQLIILNPGRTGGALEFRKILRENGAPEVTIGETSNMLFTCRSERPGQVTVNAITRAMDFACLPAAKAGWALEQIGSVLPQYQAVENVLHTSLTNIEAVLHPLPTLLNAARCESGTPFHYYTEGITPSVGALAEKVDAERIAIAKAFDLNVPSVCEWVKISYGQSPATIYEWVQGNPVLRGIMGPTSLNTVHFFEDVSTGLVPLSELGRAVNVPTPLIDAVLLLISSLIDVDFRKEGRTLEKLGLSGLTAAEIRSAVE

SEQ ID NO: 727 - DNA, 1077 bp, Artificial Sequence
  Engineered variant of opine dehydrogenase CENDH
atgatcgagtcaaaaacatacgccgttttgggattaggaaacgggggtcacgcatttgccgcctatttagcattgaagggccagcgtgtactggcttgggacatcgatgctcagagaatcaaagagattcaggaccgtggagccatcatagcggaaggaccaggacttgctgggactgctcacccggatcttctgacctcagatataggtttggcggttaaagacgctgatgtgatactgattgtagtgccggccatccaccacgcttccattgcagcaaaaatcgccagttacatttccgagggtcagttgattatccttaaccctgggcgtacgggtggagcgctggaattccggaaaatcctgcgtgaaaatggtgcgccggaggtaacgatcggggaaacctcaaacatgctctttacatgccgctccgagagaccaggacaggttacggtaaatgcgataacacgtgccatggactttgcatgtctcccagcggcaaaagctggatgggccctggaacagatagggtcggttcttcctcaataccaggctgtcgaaaacgtgttgcatacttcgctgactaatatcgaagctgtattgcacccgctgccaacactgttaaacgctgctcgttgtgagtctggtaccccattccattattataccgaggggattacgccatcagtcggggcgcttgcggagaaagtggacgctgaacgcatagcaatcgcaaaggctttcgatttaaacgttccgtcggtctgcgaatgggttaagattagttacggccagtcaccggccacaatttatgaagcggtgcagggtaatcctgtgctgcgcggcgttatgggacctaccagccttaacacggtgcacttcttcgaggatgtaagcaccggactggtaccgttatccgaactgggtcgggcagtgaatgtgcctaccccacttatcgatgctgttcttctgttgatcagttcgctgatagacgtggatttcagaaaggaaggtcgtaccttggaaaaattaggtctgagcggacttaccgccgcggaaataagaagtgctgttgag

SEQ ID NO: 728 - protein, 359 aa, Artificial Sequence
  Engineered variant of opine dehydrogenase CENDH
MIESKTYAVLGLGNGGHAFAAYLALKGQRVLAWDIDAQRIKEIQDRGAIIAEGPGLAGTAHPDLLTSDIGLAVKDADVILIVVPAIHHASIAAKIASYISEGQLIILNPGRTGGALEFRKILRENGAPEVTIGETSNMLFTCRSERPGQVTVNAITRAMDFACLPAAKAGWALEQIGSVLPQYQAVENVLHTSLTNIEAVLHPLPTLLNAARCESGTPFHYYTEGITPSVGALAEKVDAERIAIAKAFDLNVPSVCEWVKISYGQSPATIYEAVQGNPVLRGVMGPTSLNTVHFFEDVSTGLVPLSELGRAVNVPTPLIDAVLLLISSLIDVDFRKEGRTLEKLGLSGLTAAEIRSAVE

SEQ ID NO: 729 - DNA, 1077 bp, Artificial Sequence
  Engineered variant of opine dehydrogenase CENDH
atgatcgagtcaaaaacatacgccgttttgggattaggaaacgggggtcacgcatttgccgcctatttagcattgaagggccagcgtgtactggcttgggacatcgatgctcagagaatcaaagagattcaggaccgtggagccatcatagcggaaggaccaggacttgctgggactgctcacccggatcttctgacctcagatataggtttggcggttaaagacgctgatgtgatactgattgtagtgccggccatccaccacgcttccattgcagcaaaaatcgccagttacatttccgagggtcagttgattatccttaaccctgggcgtacgggtggagcgctggaattccggaaaatcctgcgtgaaaatggtgcgccggaggtaacgatcggggaaacctcaaacatgctctttacatgccgctccgagagaccaggacaggttacggtaaatgcgataacacgtgccatggactttgcatgtctcccagcggcaaaagctggatgggccctggaacagatagggtcggttcttcctcaataccaggctgtcgaaaacgtgttgcatacttcgctgactaatatcgaagctgtattgcacccgctgccaacactgttaaacgctgctcgttgtgagtctggtaccccattccattattataccgaggggattacgccatcagtcggggcgcttgcggagaaagtggacgctgaacgcatagcaatcgcaaaggctttcgatttaaacgttccgtcggtctgcgaatgggttaagattagttacggccagtcaccggccacaatttatgaagcggtgcagggtaatcctttgctgcgcggcattatgggacctaccagccttaacacggtgcacttcttcgaggatgtaagcaccggactggtaccgttatccgaactgggtcgggcagtgaatgtgcctaccccacttatcgatgctgttcttctgttgatcagttcgctgatagacgtggatttcagaaaggaaggtcgtaccttggaaaaattaggtctgagcggacttaccgccgcggaaataagaagtgctgttgag

SEQ ID NO: 730 - protein, 359 aa, Artificial Sequence
  Engineered variant of opine dehydrogenase CENDH
MIESKTYAVLGLGNGGHAFAAYLALKGQRVLAWDIDAQRIKEIQDRGAIIAEGPGLAGTAHPDLLTSDIGLAVKDADVILIVVPAIHHASIAAKIASYISEGQLIILNPGRTGGALEFRKILRENGAPEVTIGETSNMLFTCRSERPGQVTVNAITRAMDFACLPAAKAGWALEQIGSVLPQYQAVENVLHTSLTNIEAVLHPLPTLLNAARCESGTPFHYYTEGITPSVGALAEKVDAERIAIAKAFDLNVPSVCEWVKISYGQSPATIYEAVQGNPLLRGIMGPTSLNTVHFFEDVSTGLVPLSELGRAVNVPTPLIDAVLLLISSLIDVDFRKEGRTLEKLGLSGLTAAEIRSAVE

SEQ ID NO: 731 - DNA, 1077 bp, Artificial Sequence
  Engineered variant of opine dehydrogenase CENDH
atgatcgagtcaaaaacatacgccgttttgggattaggaaacgggggtcacgcatttgccgcctatttagcattgaagggccagcgtgtactggcttgggacatcgatgctcagagaatcaaagagattcaggaccgtggagccatcatagcggaaggaccaggacttgctgggactgctcacccggatcttctgacctcagatataggtttggcggttaaagacgctgatgtgatactgattgtagtgccggccatccaccacgcttccattgcagcaaaaatcgccagttacatttccgagggtcagttgattatccttaaccctgggcgtacgggtggagcgctggaattccggaaaatcctgcgtgaaaatggtgcgccggaggtaacgatcggggaaacctcaaacatgctctttacatgccgctccgagagaccaggacaggttacggtaaatgcgataacacgtgccatggactttgcatgtctcccagcggcaaaagctggatgggccctggaacagatagggtcggttcttcctcaataccaggctgtcgaaaacgtgttgcatacttcgctgactaatatcgaagctgtattgcacccgctgccaacactgttaaacgctgctcgttgtgagtctggtaccccattccattattataccgaggggattacgccatcagtcggggcgcttgcggagaaagtggacgctgaacgcatagcaatcgcaaaggctttcgatttaaacgttccgtcggtctgcgaatggtggaagattagttacggccagtcaccggccacaatttatgaagcggtgcagggtaatcctgtgctgcgcggcattatgggacctaccagccttaacacggtgcacttcttcgaggatgtaagcaccggactggtaccgttatccgaactgggtcgggcagtgaatgtgcctaccccacttatcgatgctgttcttctgttgatcagttcgctgatagacgtggatttcagaaaggaaggtcgtaccttggaaaaattaggtctgagcggacttaccgccgcggaaataagaagtgctgttgag

SEQ ID NO: 732 - protein, 359 aa, Artificial Sequence
  Engineered variant of opine dehydrogenase CENDH
MIESKTYAVLGLGNGGHAFAAYLALKGQRVLAWDIDAQRIKEIQDRGAIIAEGPGLAGTAHPDLLTSDIGLAVKDADVILIVVPAIHHASIAAKIASYISEGQLIILNPGRTGGALEFRKILRENGAPEVTIGETSNMLFTCRSERPGQVTVNAITRAMDFACLPAAKAGWALEQIGSVLPQYQAVENVLHTSLTNIEAVLHPLPTLLNAARCESGTPFHYYTEGITPSVGALAEKVDAERIAIAKAFDLNVPSVCEWWKISYGQSPATIYEAVQGNPVLRGIMGPTSLNTVHFFEDVSTGLVPLSELGRAVNVPTPLIDAVLLLISSLIDVDFRKEGRTLEKLGLSGLTAAEIRSAVE

SEQ ID NO: 733 - DNA, 1077 bp, Artificial Sequence
  Engineered variant of opine dehydrogenase CENDH
atgatcgagtcaaaaacatacgccgttttgggattaggaaacgggggtcacgcatttgccgcctatttagcattgaagggccagcgtgtactggcttgggacatcgatgctcagagaatcaaagagattcaggaccgtggagccatcatagcggaaggaccaggacttgctgggactgctcacccggatcttctgacctcagatataggtttggcggttaaagacgctgatgtgatactgattgtagtgccggccatccaccacgcttccattgcagcaaaaatcgccagttacatttccgagggtcagttgattatccttaaccctgggcgtacgggtggagcgctggaattccggaaaatcctgcgtgaaaatggtgcgccggaggtaacgatcggggaaacctcaaacatgctctttacatgccgctccgagagaccaggacaggttacggtaaatgcgataacacgtgccatggactttgcatgtctcccagcggcaaaagctggatgggccctggaacagatagggtcggttcttcctcaataccaggctgtcgaaaacgtgttgcatacttcgctgactaatatcgaagctgtattgcaccctctgccaacactgttaaacgctgctcgttgtgagtctggtaccccattccattattataccgaggggattacgccatcagtcggggcgcttgcggagaaagtggacgctgaacgcatagcaatcgcaaaggctttcgatttaaacgttccgtcggtctgcgaatgggttaagattagttacggccagtcaccggccacaatttatgaagcgatgcagggtaatcctgtgctgcgcggcattatgggacctaccagccttaacacggtgcacttcttcgaggatgtaagcaccggactggtaccgttatccgaactgggtcgggcagtgaatgtgcctaccccacttatcgatgctgttcttctgttgatcagttcgctgatagacgtggatttcagaaaggaaggtcgtaccttggaaaaattaggtctgagcggacttaccgccgcggaaataagaagtgctgttgag

SEQ ID NO: 734 - protein, 359 aa, Artificial Sequence
  Engineered variant of opine dehydrogenase CENDH
MIESKTYAVLGLGNGGHAFAAYLALKGQRVLAWDIDAQRIKEIQDRGAIIAEGPGLAGTAHPDLLTSDIGLAVKDADVILIVVPAIHHASIAAKIASYISEGQLIILNPGRTGGALEFRKILRENGAPEVTIGETSNMLFTCRSERPGQVTVNAITRAMDFACLPAAKAGWALEQIGSVLPQYQAVENVLHTSLTNIEAVLHPLPTLLNAARCESGTPFHYYTEGITPSVGALAEKVDAERIAIAKAFDLNVPSVCEWVKISYGQSPATIYEAMQGNPVLRGIMGPTSLNTVHFFEDVSTGLVPLSELGRAVNVPTPLIDAVLLLISSLIDVDFRKEGRTLEKLGLSGLTAAEIRSAVE

SEQ ID NO: 735 - DNA, 1077 bp, Artificial Sequence
  Engineered variant of opine dehydrogenase CENDH
atgatcgagtcaaaaacatacgccgttttgggattaggaaacgggggtcacgcatttgccgcctatttagcattgaagggccagcgtgtactggcttgggacatcgatgctcagagaatcaaagagattcaggaccgtggagccatcatagcggaaggaccaggacttgctgggactgctcacccggatcttctgacctcagatataggtttggcggttaaagacgctgatgtgatactgattgtagtgccggccatccaccacgcttccattgcagcaaaaatcgccagttacatttccgagggtcagttgattatccttaaccctgggcgtacgggtggagcgctggaattccggaaaatcctgcgtgaaaatggtgcgccggaggtaacgatcggggaaacctcaaacatgctctttacatgccgctccgagagaccaggacaggttacggtaaattttataacacgtgccatggactttgcatgtctcccagcggcaaaagctggatgggccctggaacagatagggtcggttcttcctcaataccaggctgtcgaaaacgtgttgcatacttcgctgactaatatcgaagctgtattgcacccgctgccaacactgttaaacgctgctcgttgtgagtctggtaccccattccattattataccgaggggattacgccatcagtcggggcgcttgcggagaaagtggacgctgaacgcatagcaatcgcaaaggctttcgatttaaacgttccgtcggtctgcgaatgggttaagattagttacggccagtcaccggccacaatttatgaagcggtgcagggtaatcctgtgctgcgcggcattatgggacctaccagccttaacacggtgcacttcttcgaggatgtaagcaccggactggtaccgttatccgaactgggtcgggcagtgaatgtgcctaccccacttatcgatgctgttcttctgttgatcagttcgctgatagacgtggatttcagaaaggaaggtcgtaccttggaaaaattaggtctgagcggacttaccgccgcggaaataagaagtgctgttgag

SEQ ID NO: 736 - protein, 359 aa, Artificial Sequence
  Engineered variant of opine dehydrogenase CENDH
MIESKTYAVLGLGNGGHAFAAYLALKGQRVLAWDIDAQRIKEIQDRGAIIAEGPGLAGTAHPDLLTSDIGLAVKDADVILIVVPAIHHASIAAKIASYISEGQLIILNPGRTGGALEFRKILRENGAPEVTIGETSNMLFTCRSERPGQVTVNFITRAMDFACLPAAKAGWALEQIGSVLPQYQAVENVLHTSLTNIEAVLHPLPTLLNAARCESGTPFHYYTEGITPSVGALAEKVDAERIAIAKAFDLNVPSVCEWVKISYGQSPATIYEAVQGNPVLRGIMGPTSLNTVHFFEDVSTGLVPLSELGRAVNVPTPLIDAVLLLISSLIDVDFRKEGRTLEKLGLSGLTAAEIRSAVE

SEQ ID NO: 737 - DNA, 1077 bp, Artificial Sequence
  Engineered variant of opine dehydrogenase CENDH
atgatcgagtcaaaaacatacgccgttttgggattaggaaacgggggtcacgcatttgccgcctatttagcattgaagggccagcgtgtactggcttgggacatcgatgctcagagaatcaaagagattcaggaccgtggagccatcatagcggaaggaccaggacttgctgggactgctcacccggatcttctgacctcagatataggtttggcggttaaagacgctgatgtgatactgattgtagtgccggccatccaccacgcttccattgcagcaaaaatcgccagttacatttccgagggtcagttgattatccttaaccctgggcgtacgggtggagcgctggaattccggaaaatcctgcgtgaaaatggtgcgccggaggtaacgatcggggaaacctcaaacatgctctttacatgccgctccgagagaccaggacaggttacggtagttgcgataacacgtgccatggactttgcatgtctcccagcggcaaaagctggatgggccctggaacagatagggtcggttcttcctcaataccaggctgtcgaaaacgtgttgcatacttcgctgactaatatcgaagctgtattgcacccgctgccaacactgttaaacgctgctcgttgtgagtctggtaccccattccattattataccgaggggattacgccatcagtcggggcgcttgcggagaaagtggacgctgaacgcatagcaatcgcaaaggctttcgatttaaacgttccgtcggtctgcgaatgggttaagattagttacggccagtcaccggccacaatttatgaagcggtgcagggtaatcctgtgctgcgcggcattatgggacctaccagccttaacacggtgcacttcttcgaggatgtaagcaccggactggtaccgttatccgaactgggtcgggcagtgaatgtgcctaccccacttatcgatgctgttcttctgttgatcagttcgctgatagacgtggatttcagaaaggaaggtcgtaccttggaaaaattaggtctgagcggacttaccgccgcggaaataagaagtgctgttgag

SEQ ID NO: 738 - protein, 359 aa, Artificial Sequence
  Engineered variant of opine dehydrogenase CENDH
MIESKTYAVLGLGNGGHAFAAYLALKGQRVLAWDIDAQRIKEIQDRGAIIAEGPGLAGTAHPDLLTSDIGLAVKDADVILIVVPAIHHASIAAKIASYISEGQLIILNPGRTGGALEFRKILRENGAPEVTIGETSNMLFTCRSERPGQVTVVAITRAMDFACLPAAKAGWALEQIGSVLPQYQAVENVLHTSLTNIEAVLHPLPTLLNAARCESGTPFHYYTEGITPSVGALAEKVDAERIAIAKAFDLNVPSVCEWVKISYGQSPATIYEAVQGNPVLRGIMGPTSLNTVHFFEDVSTGLVPLSELGRAVNVPTPLIDAVLLLISSLIDVDFRKEGRTLEKLGLSGLTAAEIRSAVE

SEQ ID NO: 739 - DNA, 1077 bp, Artificial Sequence
  Engineered variant of opine dehydrogenase CENDH
atgatcgagtcaaaaacatacgccgttttgggattaggaaacgggggtcacgcatttgccgcctatttagcattgaagggccagcgtgtactggcttgggacatcgatgctcagagaatcaaagagattcaggaccgtggagccatcatagcggaaggaccaggacttgctgggactgctcacccggatcttctgacctcagatataggtttggcggttaaagacgctgatgtgatactgattgtagtgccggccatccaccacgcttccattgcagcaaaaatcgccagttacatttccgagggtcagttgattatccttaaccctgggcgtacgggtggagcgctggaattccggaaaatcctgcgtgaaaatggtgcgccggaggtaacgatcggtgaaacctcaaacatgctctttacatgccgctccgagagaccaggacaggttacggtatatgcgataacacgtgccatggactttgcatgtctcccagcggcaaaagctggatgggccctggaacagatagggtcggttcttcctcaataccaggctgtcgaaaacgtgttgcatacttcgctgactaatatcgaagctgtattgcacccgctgccaacactgttaaacgctgctcgttgtgagtctggtaccccattccattattataccgaggggattacgccatcagtcggggcgcttgcggagaaagtggacgctgaacgcatagcaatcgcaaaggctttcgatttaaacgttccgtcggtctgcgaatgggttaagattagttacggccagtcaccggccacaatttatgaagcggtgcagggtaatcctgtgctgcgcggcattatgggacctaccagccttaacacggtgcacttcttcgaggatgtaagcaccggactggtaccgttatccgaactgggtcgggcagtgaatgtgcctaccccacttatcgatgctgttcttctgttgatcagttcgctgatagacgtggatttcagaaaggaaggtcgtaccttggaaaaattaggtctgagcggacttaccgccgcggaaataagaagtgctgttgag

SEQ ID NO: 740 - protein, 359 aa, Artificial Sequence
  Engineered variant of opine dehydrogenase CENDH
MIESKTYAVLGLGNGGHAFAAYLALKGQRVLAWDIDAQRIKEIQDRGAIIAEGPGLAGTAHPDLLTSDIGLAVKDADVILIVVPAIHHASIAAKIASYISEGQLIILNPGRTGGALEFRKILRENGAPEVTIGETSNMLFTCRSERPGQVTVYAITRAMDFACLPAAKAGWALEQIGSVLPQYQAVENVLHTSLTNIEAVLHPLPTLLNAARCESGTPFHYYTEGITPSVGALAEKVDAERIAIAKAFDLNVPSVCEWVKISYGQSPATIYEAVQGNPVLRGIMGPTSLNTVHFFEDVSTGLVPLSELGRAVNVPTPLIDAVLLLISSLIDVDFRKEGRTLEKLGLSGLTAAEIRSAVE

SEQ ID NO: 741 - DNA, 1077 bp, Artificial Sequence
  Engineered variant of opine dehydrogenase CENDH
atgatcgagtcaaaaacatacgccgttttgggattaggaaacgggggtcacgcatttgccgcctatttagcattgaagggccagcgtgtactggcttgggacatcgatgctcagagaatcaaagagattcaggaccgtggagccatcatagcggaaggaccaggacttgctgggactgctcacccggatcttctgacctcagatataggtttggcggttaaagacgctgatgtgatactgattgtagtgccggccatccaccacgcttccattgcagcaaaaatcgccagttacatttccgagggtcagttgattatccttaaccctgggcgtacgggtggagcgctggaattccggaaaatcctgcgtgaaaatggtgcgccggaggtaacgatcggggaaacctcaaacatgctcttttggtgccgctccgagagaccaggacaggttacggtaaatgcgataacacgtgccatggactttgcatgtctcccagcggcaaaagctggatgggccctggaacagatagggtcggttcttcctcaataccaggctgtcgaaaacgtgttgcatacttcgctgactaatatcgaagctgtattgcacccgctgccaacactgttaaacgctgctcgttgtgagtctggtaccccattccattattataccgaggggattacgccatcagtcggggcgcttgcggagaaagtggacgctgaacgcatagcaatcgcaaaggctttcgatttaaacgttccgtcggtctgcgaatgggttaagattagttacggccagtcaccggccacaatttatgaagcggtgcagggtaatcctgtgctgcgcggcattatgggacctaccagccttaacacggtgcacttcttcgaggatgtaagcaccggactggtaccgttatccgaactgggtcgggcagtgaatgtgcctaccccacttatcgatgctgttcttctgttgatcagttcgctgatagacgtggatttcagaaaggaaggtcgtaccttggaaaaattaggtctgagcggacttaccgccgcggaaataagaagtgctgttgag

SEQ ID NO: 742 - protein, 359 aa, Artificial Sequence
  Engineered variant of opine dehydrogenase CENDH
MIESKTYAVLGLGNGGHAFAAYLALKGQRVLAWDIDAQRIKEIQDRGAIIAEGPGLAGTAHPDLLTSDIGLAVKDADVILIVVPAIHHASIAAKIASYISEGQLIILNPGRTGGALEFRKILRENGAPEVTIGETSNMLFWCRSERPGQVTVNAITRAMDFACLPAAKAGWALEQIGSVLPQYQAVENVLHTSLTNIEAVLHPLPTLLNAARCESGTPFHYYTEGITPSVGALAEKVDAERIAIAKAFDLNVPSVCEWVKISYGQSPATIYEAVQGNPVLRGIMGPTSLNTVHFFEDVSTGLVPLSELGRAVNVPTPLIDAVLLLISSLIDVDFRKEGRTLEKLGLSGLTAAEIRSAVE

SEQ ID NO: 743 - DNA, 1077 bp, Artificial Sequence
  Engineered variant of opine dehydrogenase CENDH
atgatcgagtcaaaaacatacgccgttttgggattaggaaacgggggtcacgcatttgccgcctatttagcattgaagggccagcgtgtactggcttgggacatcgatgctcagagaatcaaagagattcaggaccgtggagccatcatagcggaaggaccaggacttgctgggactgctcacccggatcttctgacctcagatataggtttggcggttaaagacgctgatgtgatactgattgtagtgccggccatccaccacgcttccattgcagcaaaaatcgccagttacatttccgagggtcagttgattatccttaaccctgggcgtacgggtggagcgctggaattccggaaaatcctgcgtgaaaatggtgcgccggaggtaacgatcggggaaacctcaaacatgctctttacatgctggtccgagagaccaggacaggttacggtaaatgcgataacacgtgccatggactttgcatgtctcccagcggcaaaagctggatgggccctggaacagatagggtcggttcttcctcaataccaggctgtcgaaaacgtgttgcatacttcgctgactaatatcgaagctgtattgcacccgctgccaacactgttaaacgctgctcgttgtgagtctggtaccccattccattattataccgaggggattacgccatcagtcggggcgcttgcggagaaagtggacgctgaacgcatagcaatcgcaaaggctttcgatttaaacgttccgtcggtctgcgaatgggttaagattagttacggccagtcaccggccacaatttatgaagcggtgcagggtaatcctgtgctgcgcggcattatgggacctaccagccttaacacggtgcacttcttcgaggatgtaagcaccggactggtaccgttatccgaactgggtcgggcagtgaatgtgcctaccccacttatcgatgctgttcttctgttgatcagttcgctgatagacgtggatttcagaaaggaaggtcgtaccttggaaaaattaggtctgagcggacttaccgccgcggaaataagaagtgctgttgag

SEQ ID NO: 744 - protein, 359 aa, Artificial Sequence
  Engineered variant of opine dehydrogenase CENDH
MIESKTYAVLGLGNGGHAFAAYLALKGQRVLAWDIDAQRIKEIQDRGAIIAEGPGLAGTAHPDLLTSDIGLAVKDADVILIVVPAIHHASIAAKIASYISEGQLIILNPGRTGGALEFRKILRENGAPEVTIGETSNMLFTCWSERPGQVTVNAITRAMDFACLPAAKAGWALEQIGSVLPQYQAVENVLHTSLTNIEAVLHPLPTLLNAARCESGTPFHYYTEGITPSVGALAEKVDAERIAIAKAFDLNVPSVCEWVKISYGQSPATIYEAVQGNPVLRGIMGPTSLNTVHFFEDVSTGLVPLSELGRAVNVPTPLIDAVLLLISSLIDVDFRKEGRTLEKLGLSGLTAAEIRSAVE

SEQ ID NO: 745 - DNA, 1077 bp, Artificial Sequence
  Engineered variant of opine dehydrogenase CENDH
atgatcgagtcaaaaacatacgccgttttgggattaggaaacgggggtcacgcatttgccgcctatttagcattgaagggccagcgtgtactggcttgggacatcgatgctcagagaatcaaagagattcaggaccgtggagccatcatagcggaaggaccaggacttgctgggactgctcacccggatcttctgacctcagatataggtttggcggttaaagacgctgatgtgatactgattccagtgccggccatccaccacgcttccattgcagcaaaaatcgccagttacatttccgagggtcagttgattatccttaaccctgggcgtacgggtggagcgctggaattccggaaaatcctgcgtgaaaatggtgcgccggaggtaacgatcggggaaacctcaaacatgctctttacatgccgctccgagagaccaggacaggttacggtaaatgcgataacacgtgccatggactttgcatgtctcccagcggcaaaagctggatgggccctggaacagatagggtcggttcttcctcaataccaggctgtcgaaaacgtgttgcatacttcgctgactaatatcgaagctgtattgcacccgctgccaacactgttaaacgctgctcgttgtgagtctggtaccccattccattattataccgaggggattacgccatcagtcggggcgcttgcggagaaagtggacgctgaacgcatagcaatcgcaaaggctttcgatttaaacgttccgtcggtctgcgaatgggttaagattagttacggccagtcaccggccacaatttatgaagcggtgcagggtaatcctgtgctgcgcggcattatgggacctaccagccttaacacggtgcacttcttcgaggatgtaagcaccggactggtaccgttatccgaactgggtcgggcagtgaatgtgcctaccccacttatcgatgctgttcttctgttgatcagttcgctgatagacgtggatttcagaaaggaaggtcgtaccttggaaaaattaggtctgagcggacttaccgccgcggaaataagaagtgctgttgag

SEQ ID NO: 746 - protein, 359 aa, Artificial Sequence
  Engineered variant of opine dehydrogenase CENDH
MIESKTYAVLGLGNGGHAFAAYLALKGQRVLAWDIDAQRIKEIQDRGAIIAEGPGLAGTAHPDLLTSDIGLAVKDADVILIPVPAIHHASIAAKIASYISEGQLIILNPGRTGGALEFRKILRENGAPEVTIGETSNMLFTCRSERPGQVTVNAITRAMDFACLPAAKAGWALEQIGSVLPQYQAVENVLHTSLTNIEAVLHPLPTLLNAARCESGTPFHYYTEGITPSVGALAEKVDAERIAIAKAFDLNVPSVCEWVKISYGQSPATIYEAVQGNPVLRGIMGPTSLNTVHFFEDVSTGLVPLSELGRAVNVPTPLIDAVLLLISSLIDVDFRKEGRTLEKLGLSGLTAAEIRSAVE

SEQ ID NO: 747 - DNA, 1077 bp, Artificial Sequence
  Engineered variant of opine dehydrogenase CENDH
atgatcgagtcaaaaacatacgccgttttgggattaggaaacgggggtcacgcatttgccgcctatttagcattgaagggccagcgtgtactggcttgggacatcgatgctcagagaatcaaagagattcaggaccgtggagccatcatagcggaaggaccaggacttgctgggactgctcacccggatcttctgacctcagatataggtttggcggttaaagacgctgatgtgatactgattgtagtgccggccatccaccacgcttccattgcagcaaaaatcgccagttacatttccgagggtcagttgattatccttaaccctggggcgacgggtggagcgctggaattccggaaaatcctgcgtgaaaatggtgcgccggaggtaacgatcggggaaacctcaaacatgctctttacatgccgctccgagagaccaggacaggttacggtaaatgcgataacacgtgccatggactttgcatgtctcccagcggcaaaagctggatgggccctggaacagatagggtcggttcttcctcaataccaggctgtcgaaaacgtgttgcatacttcgctgactaatatcgaagctgtattgcacccgctgccaacactgttaaacgctgctcgttgtgagtctggtaccccattccattattataccgaggggattacgccatcagtcggggcgcttgcggagaaagtggacgctgaacgcatagcaatcgcaaaggctttcgatttaaacgttccgtcggtctgcgaatgggttaagattagttacggccagtcaccggccacaatttatgaagcggtgcagggtaatcctgtgctgcgcggcattatgggacctaccagccttaacacggtgcacttcttcgtggatgtaagcaccggactggtaccgttatccgaactgggtcgggcagtgaatgtgcctaccccacttatcgatgctgttcttctgttgatcagttcgctgatagacgtggatttcagaaaggaaggtcgtaccttggaaaaattaggtctgagcggacttaccgccgcggaaataagaagtgctgttgag

SEQ ID NO: 748 - protein, 359 aa, Artificial Sequence
  Engineered variant of opine dehydrogenase CENDH
MIESKTYAVLGLGNGGHAFAAYLALKGQRVLAWDIDAQRIKEIQDRGAIIAEGPGLAGTAHPDLLTSDIGLAVKDADVILIVVPAIHHASIAAKIASYISEGQLIILNPGATGGALEFRKILRENGAPEVTIGETSNMLFTCRSERPGQVTVNAITRAMDFACLPAAKAGWALEQIGSVLPQYQAVENVLHTSLTNIEAVLHPLPTLLNAARCESGTPFHYYTEGITPSVGALAEKVDAERIAIAKAFDLNVPSVCEWVKISYGQSPATIYEAVQGNPVLRGIMGPTSLNTVHFFVDVSTGLVPLSELGRAVNVPTPLIDAVLLLISSLIDVDFRKEGRTLEKLGLSGLTAAEIRSAVE

SEQ ID NO: 749 - DNA, 1077 bp, Artificial Sequence
  Engineered variant of opine dehydrogenase CENDH
atgatcgagtcaaaaacatacgccgttttgggattaggaaacgggggtcacgcatttgccgcctatttagcattgaagggccagcgtgtactggcttgggacatcgatgctcagagaatcaaagagattcaggaccgtggagccatcatagcggaaggaccaggacttgctgggactgctcacccggatcttctgacctcagatataggtttggcggttaaagacgctgatgtgatactgattgtagtgccggccatccaccacgcttccattgcagcaaaaatcgccagttacatttccgagggtcagttgattatccttaaccctggggcgacgggtggagcgctggaattccggaaaatcctgcgtgaaaatggtgcgccggaggtaacgatcggggaaacctcaaacatgctctttacatgccgctccgagagaccaggacaggttacggtaaatgcgataacacgtgccatggactttgcatgtctcccagcggcaaaagctggatgggccctggaacagatagggtcggttcttcctcaataccaggctgtcgaaaacgtgttgcatacttcgctgactaatatcgaagctgtattgcacccgctgccaacactgttaaacgctgctcgttgtgagtctggtaccccattccattattataccgaggggattacgccatcagtcggggcgcttgcggagaaagtggacgctgaacgcatagcaatcgcaaaggctttcgatttaaacgttccgtcggtctgcgaatgggttaagattagttacggccagtcaccggccacaatttatgaagcggtgcagggtaatcctgtgctgcgcggcattatgggacctaccagccttaacacggtgcacttcttcaacgatgtaagcaccggactggtaccgttatccgaactgggtcgggcagtgaatgtgcctaccccacttatcgatgctgttcttctgttgatcagttcgctgatagacgtggatttcagaaaggaaggtcgtaccttggaaaaattaggtctgagcggacttaccgccgcggaaataagaagtgctgttgag

SEQ ID NO: 750 - protein, 359 aa, Artificial Sequence
  Engineered variant of opine dehydrogenase CENDH
MIESKTYAVLGLGNGGHAFAAYLALKGQRVLAWDIDAQRIKEIQDRGAIIAEGPGLAGTAHPDLLTSDIGLAVKDADVILIVVPAIHHASIAAKIASYISEGQLIILNPGATGGALEFRKILRENGAPEVTIGETSNMLFTCRSERPGQVTVNAITRAMDFACLPAAKAGWALEQIGSVLPQYQAVENVLHTSLTNIEAVLHPLPTLLNAARCESGTPFHYYTEGITPSVGALAEKVDAERIAIAKAFDLNVPSVCEWVKISYGQSPATIYEAVQGNPVLRGIMGPTSLNTVHFFNDVSTGLVPLSELGRAVNVPTPLIDAVLLLISSLIDVDFRKEGRTLEKLGLSGLTAAEIRSAVE

What is claimed is:

1. An engineered polypeptide having imine reductase activity, comprising SEQ ID NO:96.

2. The engineered polypeptide of claim 1 which is capable of converting substrate compound (1a) pyruvate,

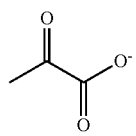
(1a)

and substrate compound (2b) butylamine

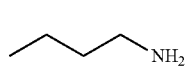
(2b)

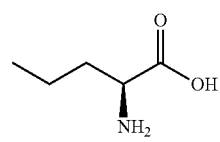
(2a)

to product compound (3c), (S)-2-(cyclohexylamino)pentanoic acid,

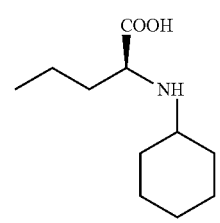
(3c)

under suitable reaction conditions.

4. The engineered polypeptide of claim 1 which is capable of converting substrate compound (1b) cyclohexanone,

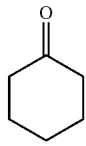
(1b)

and substrate compound (2b) butylamine

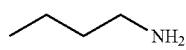
(2b)

to product compound (3d), N-butylcyclohexanamine,

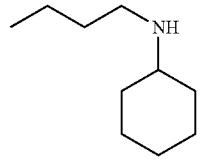
(3d)

under suitable reaction conditions.

5. The engineered polypeptide of claim 1 which is capable of converting substrate compound (1i),

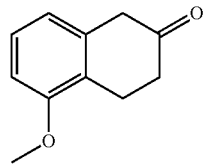
(1i)

and substrate compound (2b)

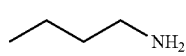
(2b)

to product compound (3n),

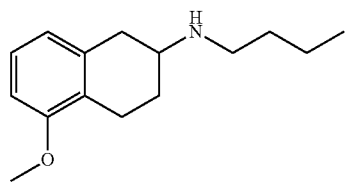
(3n)

under suitable reaction conditions.

6. The engineered polypeptide of claim 1 which is capable of converting substrate compound (1j),

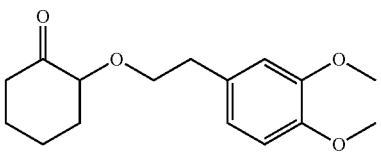
(1j)

and substrate compound (2b)

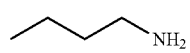
(2b)

to product compound (3o),

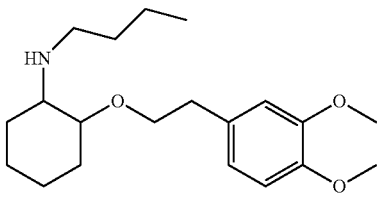
(3o)

under suitable reaction conditions.

7. A process for preparing an amine compound of formula (III),

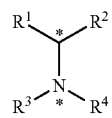
(III)

wherein (a) $R^1$ and $R^2$ are independently selected from the group consisting of a hydrogen atom, an optionally substituted alkyl, an optionally substituted alkenyl, an optionally substituted alkynyl, an optionally substituted alkoxy, an optionally substituted carboxy, an optionally substituted aminocarbonyl, an optionally substituted heteroalkyl, an optionally substituted heteroalkenyl, an optionally substituted heteroalkynyl, an optionally substituted carboxyalkyl, an optionally substituted aminoalkyl, an optionally substituted haloalkyl, an optionally substituted alkylthioalkyl, an optionally substituted cycloalkyl, an optionally substituted aryl, an optionally substituted arylalkyl, an optionally substituted heterocycloalkyl, an optionally substituted heteroaryl, and an optionally substituted heteroarylalkyl;

(b) $R^1$ and $R^2$ are linked to form a 3-membered to 10-membered ring;

(c) $R^3$ and $R^4$ are independently selected from the group consisting of a hydrogen atom, an optionally substituted alkyl, an optionally substituted alkenyl, an optionally substituted alkynyl, an optionally substituted alkoxy, an optionally substituted carboxy, an optionally substituted aminocarbonyl, an optionally substituted heteroalkyl, an optionally substituted heteroalkenyl, an optionally substituted heteroalkynyl, an optionally substituted carboxyalkyl, an optionally substituted aminoalkyl, an optionally substituted haloalkyl, an optionally substituted alkylthioalkyl, an optionally substituted cycloalkyl, an optionally substituted aryl, an optionally substituted arylalkyl, an optionally substituted heterocycloalkyl, an optionally substituted heteroaryl, and an optionally substituted heteroarylalkyl, with the proviso that both $R^3$ and $R^4$ cannot be hydrogen;

(d) $R^3$ and $R^4$ are linked to form a 3-membered to 10-membered ring; or (e) at least one of $R^1$ and $R^2$ is linked to at least one of $R^3$ and $R^4$;

wherein optionally, the carbon atom and/or the nitrogen indicated by * is chiral;

the process comprising contacting a compound of formula (I),

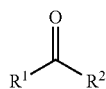

(I)

wherein $R^1$ and $R^2$ are as defined in (a) or (b) above; and a compound of formula (II),

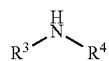

(II)

wherein $R^3$ and $R^4$ are as defined in (c) or (d) above;

with an engineered polypeptide having imine reductase activity in presence of a cofactor under suitable reaction conditions, wherein the engineered polypeptide is the engineered polypeptide of claim 1.

8. The process of claim 7 in which $R^3$ and $R^4$ are linked to form a 3-membered to 10-membered ring.

9. The process of claim 7 in which the substrate compound of formula (II) is selected from methylamine, dimethylamine, isopropylamine, butylamine, isobutylaminel, L-norvaline, aniline, (S)-2-aminopent-4-enoic acid, pyrrolidine, and hydroxypyrrolidine.

10. The process of claim 7, wherein at least one of $R^1$ and $R^2$ of the compound of formula (I) is linked to at least one of $R^3$ and $R^4$ of the amine compound of formula (II), whereby the process for preparing the amine compound of formula (III) comprises an intramolecular reaction.

11. The process of claim 7 in which the suitable reaction conditions comprise (a) substrate loading at about 10 g/L to 100 g/L;

(b) about 0.1 g/L to about 50 g/L of the engineered polypeptide;

(c) about 0.05 g/L (0.001 M) to about 2.5 g/L (0.050 M) of NAD(P)H;

(d) a pH of about 6 to 10;

(e) temperature of about 20° to 50° C.; and (f) reaction time of 2-120 hrs.

* * * * *